United States Patent 7,745,391 (HUMAN THROMBOSPONDIN POLYPEPTIDE) - sequence listing, part 118

SEQ ID NO: 339011 - DNA, 3997 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339012 - DNA, 4055 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggtcagcacgggcccggccccatgcctcattcaccaggcccttaggcccctcccctgccccatgcctccctggtgccagccctcctgccccctcacaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339013 - DNA, 3979 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgtgagtgagcgtttggttgaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339014 - DNA, 2919 bp, Homo sapiens
gtagaaggcctcgcgttagtcggacgacgactaacacggagatttaggagtcaggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339015 - DNA, 1248 bp, Homo sapiens
  misc_feature (53)..(53): n is a, c, g, or t
ccagctctgactcaaggtcaagcaggatcccgttgagctgctccatctgtagngcgtagcgggcctccacctccctcaggctgttctccaagctggccttcagatttctcatggagtccaggtcgatctccaaggactggactgttacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339016 - DNA, 2587 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccacgccacccctgctggtaccgagctcgattc

SEQ ID NO: 339017 - DNA, 1113 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagcaggaagccctctcaagaccctgttccatacttgtacaataggtatctctagctcctgctactgctagcaagattattagcttccgctgttgcctgaagcatggactttggatgtggaagttcttctcctgatatatactcata

SEQ ID NO: 339018 - DNA, 714 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacaggtgagtgggatgggagagatgggataatcaaccataaacctttggtgagctcttttacagtttcacttaaggcttctactccatttactcattcacatatttaagcaaggggctgctgtgtgtc

SEQ ID NO: 339019 - DNA, 577 bp, Homo sapiens
tctggactctcaattctattctgtatgtccatatgcttatccttatgccagtaccacactgttttaattactgtaccttgtagtaagttatgaaatcaggacatatgagtcttccgacattttaaagaatgtcttccttaatttctgtatatttgtgaattttctagttatcattctgttactgatttctagcttcattccatgtagtcagagataatgttttatatgacttcagtcttccaaaatttattgagacacttttagtgggctaacatatggcctatcctggagaatctatacttgagaagaatgtatattctgctgttattgggtggaatgccttgtatatctctcttaggtctactttataattttgttcaagtcctctgttacttatcgatcttctgtctaggtgttctgttcattattgaacgtggttcattaaaagtctccaaatatctgtaggccacagttggtggggacaaaaaagtctccaaatattttttctgcacttctgtcagaacttgcttcatgtttgggggctcttgtttattgcatatgttttttaatagcttga

SEQ ID NO: 339020 - DNA, 588 bp, Homo sapiens
aaagaataactcattgtttcaggattagagagattaaaggcttggttaggttctagaatagatgacttaaaatgcatttgggaatttaaaaaaattctctcattctctataacatctctgactttctttccctcttttttttctatcagtctctttctctagcccttttttcgcctttgtctttagtcttcacctttctggattcctcaacctttcactgtaggctccaagtctctatctttctgtctctgggcttttgtcccccctctcttggtctgtgtcaccccctttttggatttcttttccctccatataactctttctcttttctctgtctctttctttcttgtctctctcttctcccccacaccctttttctctctgtctctctccctctcttatttcctttttatgggtctccatcaacctctttctctgggtctcggtctctctctctcgtgggtctcggtttccctcgtctctggggttctgtctccctctgtctctgggtctctgtctctgggtctctgtctactcctatgtctctgggtctctgtatctctctctgggtctctgtctcactctgtc

SEQ ID NO: 339021 - DNA, 149 bp, Homo sapiens
cttgacacactggtgctgtgaggaggaagatgtgggcactcttaggtccctggtcctaggggtctgtgctggggtggggctcgttgacctgcatcctggctggccctgtgactctgcctgtttacagtgagcagctcctggccaaaagc

SEQ ID NO: 339022 - DNA, 1081 bp, Homo sapiens
tgagtgttcagtgttcactgttttttgtttttttttagacggagccttgctctgttgcccaagctacagtgcagtggtgcaatcttggctcaccgcaacctccgccgccggggttcaagcagttcttctgcctcagcctcccgagtagctggggttacaggtgaccgctaccatgcctggctaatttttgcatttttaatagacatggggttttgccatgttggccagtctggtctcgaactcccgacctcaggtgatcctcccgcctcagccccccaaactgcagagattacaggcgtgagccatcgcacctggccttgttcattgttatatttgtctatttgaacagaaagaaaaggaagtgaataactaccttcaatggcagtaagataagttacttaatgggctacaaaaaggaataccaatacatggaagtaccaatacctgctacaacatggatggaccgtgaaaacattacgttaagcgagagaagccaggaacaaaggaccatatattgtatgattccattgatatgaaatgtccagaatagacaaacctacgcagacagaaagtagattaagggttgccagagtcaaggagaaatggggataggagttgggggtggtagttgctgacagctaatgacagataaacggtgtggggtttctttttggagtaatgaatatgtcctaagttgtagtgatgcacaattctgcaaatatactaaaagccatttaattatagactggcatgggaattatacctaaataaagctgttttgaaaaatgataaatgactactctttctctaggtactggatttatatgctcaatttatctttcatcattcagaaaaacaaaaggaaatgaaggacaatatttttattttatatatttatttttgagaccaagtctcgctctgtcacccacctgttgcaagtcaaagttcaaagaaatgcaccatgcacttgctcacccagattacatcccaaatgttacgctgaggcattctggaatgttattaccaagatgtttccatgtcacaatgacattgcaaccacctcctcactgaacatcacatg

SEQ ID NO: 339023 - DNA, 2568 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339024 - DNA, 2627 bp, Homo sapiens
aggcgcagtttgccggccgccatcgcgcactggggctccgggcggctgggaccggcctggggtagctgcgcagcaggtgggtcggtcccggggatgcagcgcgggggtcagagagcgaccccaacagggtagacggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339025 - DNA, 3362 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339026 - DNA, 3259 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339027 - DNA, 2474 bp, Homo sapiens
ttttttttttatgttgatgccttttatttctttggtttttaaccccactcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339028 - DNA, 3516 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtgatcttttcattgattgcatttattctcaagattacagtatcattcccattgcctgcgcataaacttaactgctccctgcgcataaacttaactgctccctgtagatacagaaactggtgcctctttttctgtcactgtgtttgagcaggcagtctgttgtaatgacccccaaatcacagagacttagtaagtacttattcatgggccgggcgtggtggctcacacctgtaatcccaacactttgtgaggctgaggcaggcagatcatggagtttgagaccagcctggccaacatggtgaaaccctgtctctactaaaaatacaaaaaattagccagctgtggtgatgcgtgcctgtaatcccagctactcaggaggctgaggcaggagaattgcttgaacctgggaggcggaggttgcagtaagccaagattgtgccactgcaccctagcctaggtgacagtgcaagactccatctcagaaaaaaaagaaaaaaagaaaaaaaaattatttactaacagtcgattgtcctgtgttggtgttgctgttgcttatatattggtttgcactctgctccatacagtgattcagggatccaggccccatctctgttgtagctctgctcttcactgtacccttggagcatgtagggaaggccgaacctgttcacctgggagatgacacacatcacttctactcacaaatccttggagagaaatgatcccatggctccagtcacttgaaagggcctgtgaactgtcacctggagtgcctgtctccgcaacagttacaagcttagttcccctcttagcctatccatcttaagccccaagctgagtgtggttctggtaagaaaaaggctaaaatggtctgggcacggtggctcacgcctgtaatcccagcactttgagaggcacctttaaaaaaaagataaaaacaa

SEQ ID NO: 339029 - DNA, 2664 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggcttcacataaataataaaactaattattaatttaaaagtttttatatattttagtgtaattgtttttttatttagtctattaaaaaatctttgggggg

SEQ ID NO: 339030 - DNA, 3636 bp, Homo sapiens
ttttttttttatgttgatgccttttatttctttggtttttaaccccactcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtgatcttttcattgattgcatttattctcaagattacagtatcattcccattgcctgcgcataaacttaactgctccctgcgcataaacttaactgctccctgtagatacagaaactggtgcctctttttctgtcactgtgtttgagcaggcagtctgttgtaatgacccccaaatcacagagacttagtaagtacttattcatgggccgggcgtggtggctcacacctgtaatcccaacactttgtgaggctgaggcaggcagatcatggagtttgagaccagcctggccaacatggtgaaaccctgtctctactaaaaatacaaaaaattagccagctgtggtgatgcgtgcctgtaatcccagctactcaggaggctgaggcaggagaattgcttgaacctgggaggcggaggttgcagtaagccaagattgtgccactgcaccctagcctaggtgacagtgcaagactccatctcagaaaaaaaagaaaaaaagaaaaaaaaattatttactaacagtcgattgtcctgtgttggtgttgctgttgcttatatattggtttgcactctgctccatacagtgattcagggatccaggccccatctctgttgtagctctgctcttcactgtacccttggagcatgtagggaaggccgaacctgttcacctgggagatgacacacatcacttctactcacaaatccttggagagaaatgatcccatggctccagtcacttgaaagggcctgtgaactgtcacctggagtgcctgtctccgcaacagttacaagcttagttcccctcttagcctatccatcttaagccccaagctgagtgtggttctggtaagaaaaaggctaaaatggtctgggcacggtggctcacgcctgtaatcccagcactttgagaggcagaggcaggtggatcacctgaggtcaggagttcaaaagcagcctggccaacatggggaaactccatctctactaaaaatacaaaaaatgagccaggcgtggtggcaggcacctgtgatttcagctactcaggaggctgaggcaggggaatcgcttgaaccggggaggcggaagttgcagtgagccaagatcacaccactgcactcctgcctgggggacagagcgagactccatctcatt

SEQ ID NO: 339031 - DNA, 1744 bp, Homo sapiens
aggccattgccttgtccgtgtcctctgcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtgagtgcccagctagcctggcagcctctgctgggccttaggtggggtgttgggcagaggcctgtggttgggagagggcagaagggcagccagggagtcaggggctccatggtccatgctatcattgggacttcctcctgtagtttctctgaatgttagacattgtttattaaattagtcttcagagattatgcagatcatccatacttaccacaaatagtgaagaaacatcaatacataaagaaaagaatctcccaacccccgaccatgaaccctctgaaaataaagggtctcaagtgtcctgatgcacgtcccctcatgtctccctgcacatcacacatgcataatcagggcctggggtcgggctctgtgtgtgtggtgtgctgtgtctgagtgcttgctgttcgaggggtgggtcccccaggctgtggttgggtctggttctttagttgcccagcatcgcgtgctcagcccatccccatcctagaggtgggctctctgccccttggagtgaagctgccctgacacctcctgacttgtgtgcccatatgtgaggctctgggcactgtgggtggactcctcaggaccactgggcaagtggtgtgtgagttcgacatttcacataaaatagaaacttccatgtggttttccagaagttttgtggctgttcattaccagcacggaaggtgcccactggcctggatacagcccagcactatgtggtgttgctttttaggatttccacgaaggccaggcacagtgcctcatgcctgtaatcgcagcactttgggaagccaaggcgggcagatcacttgagcccgggcattcgagaccagcctgggcaacatagggagaccccatctctacaaaaaatacaaaaattagccgggtccgcacttttagtcccagctacttgggaggctgaggtgggaggattgcttgagtccaggaggtggaggttgcagtgagccaagatcatgccactgcactccagcctaggtgacagagcaagaccctgtctttaaaaaacaaacaaaccaaa

SEQ ID NO: 339032 - DNA, 2812 bp, Homo sapiens
aggcgcagtttgccggccgccatcgcgcactggggctccgggcggctgggaccggcctggggtagctgcgcagcaggtgggtcggtcccggggatgcagcgcgggggtcagagagcgaccccaacagggtagacggtgaggacgcctcagtgggcagcgttagggaaaggggccagggtgttcccggggttggggtgcgagcccccgctgtgcgtccaggaggccgagggtctggcatcccttcgcgtggagtgcggggcaggggccgggtccccccggaggtggctgagatccagatcggtgaggggccctgcaggcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339033 - DNA, 1712 bp, Homo sapiens
gacctgaagagctaccggaagctgctcctgtgggggtatcagctttcccaggagcagttcccccacaggagcagttccggtaggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 339034 - DNA, 2561 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttctggaagggaggatgtgaacaatttaagtcgcaatcactgataatgatcttattgtctgagcaatggaacttaactttc

SEQ ID NO: 339035 - DNA, 1790 bp, Homo sapiens
aggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtgagtgcccagctagcctggcagcctctgctgggccttaggtggggtgttgggcagaggcctgtggttgggagagggcagaagggcagccagggagtcaggggctccatggtccatgctatcattgggacttcctcctgtagtttctctgaatgttagacattgtttattaaattagtcttcagagattatgcagatcatccatacttaccacaaatagtgaagaaacatcaatacataaagaaaagaatctcccaacccccgaccatgaaccctctgaaaataaagggtctcaagtgtcctgatgcacgtcccctcatgtctccctgcacatcacacatgcataatcagggcctggggtcgggctctgtgtgtgtggtgtgctgtgtctgagtgcttgctgttcgaggggtgggtcccccaggctgtggttgggtctggttctttagttgcccagcatcgcgtgctcagcccatccccatcctagaggtgggctctctgccccttggagtgaagctgccctgacacctcctgacttgtgtgcccatatgtgaggctctgggcactgtgggtggactcctcaggaccactgggcaagtggtgtgtgagttcgacatttcacataaaatagaaacttccatgtggttttccagaagttttgtggctgttcattaccagcacggaaggtgcccactggcctggatacagcccagcactatgtggtgttgctttttaggatttccacgaaggccaggcacagtgcctcatgcctgtaatcgcagcactttgggaagccaaggcgggcagatcacttgagcccgggcattcgagaccagcctgggcaacatagggagaccccatctctacaaaaaatacaaaaattagccgggtccgcacttttagtcccagctacttgggaggctgaggtgggaggattgcttgagtccaggaggtggaggttgcagtgagccaagatcatgccactgcactccagcctaggtgacagagcaagaccctgtctttaaaaaacaaacaaaccaaa

SEQ ID NO: 339036 - DNA, 256 bp, Homo sapiens
tttgattcccacgtccctccacgatgcattccccagcttcctgggatgctgacaaggctgcttcaggcagccacagtaaaaccaatgacatcacgaactcacagctagcagttttgggtgggaacatttagcttttgtaaaacacaacattttcatcccacccttaacctgactcctttttttttttttgggagacagagtctccctcttggcccagggtggattggcagggggcgtgatctcggctcactgcaag

SEQ ID NO: 339037 - DNA, 219 bp, Homo sapiens
aaattatgacaataaatgatatggtaaagtatgctaacaataaatggtaataaattgtattaacaaatgcaacatgttatcggtaaattatgaaacattcgtaatagtaatatataacccataaagtgggcagaatggaagggaaaaaacctatttcttaggttttaaaaatcagacatttttgtatccgggtgtggtggctcacgcctgtaatcccag

SEQ ID NO: 339038 - DNA, 841 bp, Homo sapiens
aaaaaacatcataggatactcgacctcacggatactcaagaaatacaaattgaaatgaatactgtttcccacatactggattggcaaagattataaagatgtgtaaaacctggtatggacattggaaaatcaggcattcttgttctgagttcatttatgcatgcaacagatagcaactcctgtgttcaggcatgttctaagcactggggatacagcactgaacaagacccccacctttaaagatcataggttccaactaggtgaaagctgatagtaaaaatatatattatttttgagggaattaagtacaatgaagaaaaagcaagaaaagataaatgataaggtaggccattttttaaagggcggctgagggaggatcctctggggcagtggcattagagcagagaccaacttgcctggaacacagtagcacgagcagccatgcagccatccagggggagatcagcccaggcagaggaaagatgtgcagaggttctgagcaggggcatgctggatgcagtcaaggactggcagggtgtccagagtggctggagcactgtggataaaggggagagggagagcagatgggcaggtgggatggtagaggttgctctgaggtcacggtaaggatgaccttaccacggttggcttttttctcaaatgtcacaggaagccactggaaatttttaaacaaaagaatgatgtgatccaatgtatatcataaaagtatcactgactactctgatgagtacaccgtagtggggatgtgagcagtggttagagagttcattttgaattgaatgtattttgttactctctacctgtttcacttattgtaagg

SEQ ID NO: 339039 - DNA, 224 bp, Homo sapiens
aaaaagagaaatgcaaaagcgaagagaagcagagtcgcacaggaatgttattctttcaaaagataaaagtataaaaccagaacttctggaagaagaaaatacgcattcttaccactgcctaaaaagaaaccttagtttctggttaatcctcaggaaatatcagagaaatgctgattttttttttttcaaggctgaccaaaaagtccacttctgaacacagcttt

SEQ ID NO: 339040 - DNA, 272 bp, Homo sapiens
ctcccaaagtgctgggattacaggcatgagccactgcacccagccccttttcgggcttcttactctttttcaccttgcctcaggccctgagtagttccagctactttcacttcttctttaccaccttccctattcagtccatccacttgtgagagttgtggagggcagcaggggaagcatcagttgtcctacaaaacctgactgcactacagggcaacagtctctttagccactctcctccatgttgccctgaagattaacactctgggcat

SEQ ID NO: 339041 - DNA, 572 bp, Homo sapiens
tcccaagctcaggccttaagaagctctgatgtcctttttattggagacaaggagcggctggagaggtgtttgatttttacctctttccccttgccctcgccccctgactatcaatataaggtagaaaatacagaaaaaatataaagaaacagaaagaaaaatataatcccacatacacaaccccagctcccagaagccactaaacctaacatcttagtatatttcccccaggtgtgtttttttctgcaatttttctttacacagcaggaaggttatgttacatgtacatttttacagttttaacttcactttagcacataattattttccttcgtcactaaacctcacgttacggataacttaccctttcatcttacagataggtcatataattattccttattttgaactcacaggttgtttctaggttttcattactctaagtttacaacaagcacccttgtgcacgatggtttatcttatttgaatgactgggatttctgggtttgctgagcagctgtattttctgtttagagtgtcaggctgcctctggaatgcttgagaagcaccag

SEQ ID NO: 339042 - DNA, 638 bp, Homo sapiens
agaatcacaaaggggagtaggggtcattttttcacccatctcggatcacagggagaagcaagttgggcaaatgactggagaaaaaacaaaggcaagccgagtgctggggagagatgttcccctgaagtgagacggggctggaccgtaggagaaaggggagagggagggctggcgggggcaactgacagctgacagcagaggcgccgaggcggaggctggaggaaccaggtgcgaatctcgtgcttctcaggggggaaaagaaaaggggggggacacctgctcacaatggattttctcatctgctctgaggttttggcaccccccaggctggtattctcagtatggtatggtccaaataattagcagcaccgccagctcccagggcaggctttgggggtctgcaccagcagcaaaacaataaacagtgatgcctgatgctgcagccaaagttgccgggaaataagtgcgggaatcgtcagagcttggagagggatggaggaaccgagagagaggagcggaggcagcggggagggggaagggaggacaaagggtggatgaataatgcttttgcaaaggggagaaagcaacacgcagcaggaggaggaaatttgcaaagagaaaaaaattcatttggagaa

SEQ ID NO: 339043 - DNA, 361 bp, Homo sapiens
acagaaacagggaaaatacttgtaagtaggagtcatggaaggcaagaggataagtgagaagcaggtcatggatagatagaggcagaggattaatgtcaaaccaagggcctgtctcatttagcagactagattcacaagtgctatcttggacacttggtattaagtcaacttcgaggtcacatggtgataggtcacatgatagtgaactgacgaatgtcgtcagcaatactcagtgttctttagagtctgaggaggacgagaatggaggaaagacttctctatggagtgataatacttggtgatcactagggacctgcgctcctcccctggctttaaacaagagagaatgattggaatggaa

SEQ ID NO: 339044 - DNA, 658 bp, Homo sapiens
gaggcacagggaggagaaggccatgtggagatggagcagacactggagttatattgccacaaggcagggaacacctggagtcactagaagctggaatagaaggcatgaattccacctagagcctttggagggcacatggttctgccaacaccttggtttcagaattctggcctccagaactatgacaaaatgaatttctccgagttaagccaccaagtttgtggttatttgttagacagtcctaggaaactaatatacttgagaaacttaaacaccagaatcaccttagaaaagtgatttctgaaagcaggaaaaaaaaataaggtgactcatgattgtatcttcaaagctagtttctataccataggatccaacgtgcctggcacactgcacatcctcatcagttgccacttcatccccatacgcattccagaaacccattctgttaccaccatatggctactgcccaaccacagctactctccaaagtctgcatttcctaattaatttagactaaaactgcattagaatcaccacatataatctgccagaagccctgaaaatcctggagattctgattcaggaaacctggggtggggcctaagtatttgcatgtttaacaagcttcacataagatactaatgtcgaccaaagactg

SEQ ID NO: 339045 - DNA, 1672 bp, Homo sapiens
gcgcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggagggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339046 - DNA, 1802 bp, Homo sapiens
gcgcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggtaagagaaatagttaccgcaaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339047 - DNA, 1792 bp, Homo sapiens
ggcctagcgcgtcccggccgggcccggcgcccggccagcgtctccgcttcagctcgccgccgcgcttcggccgccgggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggagggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339048 - DNA, 1598 bp, Homo sapiens
tcatacacctgaatttaagtgtcagaatactgttccatgccaaaagttttatgctgcaagttagggttaaagctaaaacctgttagaattgagaatgatggcagtagcagcagcagggatcattaagtggcatttcggcagaagcctggattttaatgtattgagtggggcctatcactagataagagccatcagcaaagtgagtacccagatctaaagaatttctccgtaaattgttagtgttccttcccattcatttcttccaggttaagcgttttatgaagttcattgtgccttgatgttcttcatttctttagttactaccaggtcaagtaatctagcacaaaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggtaagagaaatagttaccgcaaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339049 - DNA, 422 bp, Homo sapiens
ttacagtatggtataactctattatttaattttaattttgtgtttcttcatacacctgaatttaagtgtcagaatactgttccatgccaaaagttttatgctgcaagttagggttaaagctaaaacctgttagaattgagaatgatggcagtagcagcagcagggatcattaagtggcatttcggcagaagcctggattttaatgtattgagtggggcctatcactagataagagccatcagcaaagtgagtacccagatctaaagaatttctccgtaaattgttagtgttccttcccattcatttcttccaggttaagcgttttatgaagttcattgtgccttgatgttcttcatttctttagttactaccaggtcaagtaatctagcacaaaggtaatattcagtttcttttgttctttg

SEQ ID NO: 339050 - DNA, 1805 bp, Homo sapiens
gcgcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggagggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339051 - DNA, 1743 bp, Homo sapiens
  misc_feature (49)..(49): n is a, c, g, or t
  misc_feature (51)..(52): n is a, c, g, or t
  misc_feature (59)..(59): n is a, c, g, or t
  misc_feature (75)..(75): n is a, c, g, or t
  misc_feature (100)..(100): n is a, c, g, or t
attgtttatcccccagagtctgcaattcaattttcatataaggatgaanannatggaancagaggaggaaaacanagaaaccgcttggaaccaatggatnccatatttgttaagcaagttaaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggagggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339052 - DNA, 1871 bp, Homo sapiens
ggcctagcgcgtcccggccgggcccggcgcccggccagcgtctccgcttcagctcgccgccgcgcttcggccgccgggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggttaagcgttttatgaagttcattgtgccttgatgttcttcatttctttagttactaccaggtcaagtaatctagcacaaaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggtaagagaaatagttaccgcaaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggtaagttttatttattcatatatgagttgttttacagtcatgaatgttcggaaaatatttttgagatggaagtattaaagatggaatttaaaaaaaattctagaatttaaaaaccctctggttccttttacagaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattcaccaagcagtattgttagtagtatccattcgttcctaaaatgttcacaatgaacggagtctacaacttaaggggaaaatatgttatggtcttgaaatgaaacttgaaaactttagtatttagtctaaaatatttttctgatttttataaagaaagaaattgaatagaatacttaactcctttactaagcttaaatactgctgatgataaaaatataaatttcatctgggcacggtggctcacgcctgtaatcccagcactttgggaggccgaggcgggcggatcatgaggtcaggagttcgagactagcctggccaatgtggtgaaaccctatctctaccctatctcta

SEQ ID NO: 339053 - DNA, 325 bp, Homo sapiens
agcaggtgggttgcataaaaaatatagcatctagatcagggacaaatggaaaagaaggcgatattactgcattaggttcccagaggtgctatacaaacagaaacatgttttctaaatggtgaaacaggtattgaaatgactctttatcagaactatgagtctttttcgcaagagaaattggatttactagttgaatgtttttctcttcctctggccacaaaggatattggggcaacttgagagaggaatcaataatgtagagtctgatggacactcaatgatcagcctcataatctgactacataagcacaataaaacaaagtca

SEQ ID NO: 339054 - DNA, 677 bp, Homo sapiens
ctgggggtggatgggaatcacagctggggtctactgtgattagcaatgtgtgtgggggtggagatggggtctgtgagagcctaataaaaccttaaagccaaatgggctttacctaccgggtttaatagttttaaacacagacagcaagctaccctgcctgttttcatttcttactattaccattgacttgatttttttctttgaagtggcccagggcttccaacccaatcctgtttatttgtgtttccgggggactatatcagcaacttggtgccctttcttttgtgtaatcctttggacgtcacttccccacaaaaggaagcatggtccccattagccaggtaataaaatgtaaacactgcagaaaattccagctttctttgcagtttgtgtgttttcttctctgaaaacccatacactgtgccagctcaggtttgtatcatctccagtgttttaggtttttaaagcgaattaattgttttttgaaataatgtacctctatcttctagttaaaatgcatctgaactcagtctcttctaggggacctaacagatctgcgtgtgtgtttttaaacatactttgataattataccctactccaaagactaatgcagacccaaagtatatgcagtaatcctccacatataaagtaagactagcgtgcctttgactggtgg

SEQ ID NO: 339055 - DNA, 366 bp, Homo sapiens
atatctgcagtaaccatactatgatataaaaatccctgttttattggtgacagtatcacaggcgctagtagtgcaattgcggtttattggctacagtcgtaattaaagtgagtgctgaatgtcagaaaatagagatgtaacttttttcttgttcaagttcgtggatcctctggatttaacagattaagtatccttggctgaggatcacatagctaattagttacagtgccatctgagcaagacagtgatacttgttgaccacctctttgcacataacactgtaccggatattatataattataatgacccgaagaaggcctggccttaacttggtcatgggttttttttttttttttttttttttt

SEQ ID NO: 339056 - DNA, 608 bp, Homo sapiens
caacaccaaataccaactgctttaatgttttacttttgtacttagaagtccagttaagcacatagctaataatgccaaatttctgggttcagggtcaatttccctggctcttcttccatcttcccaggttatacccctcactctacctagctattaagaattcttgcacatatttcacccataggtgggattgctaaatgatgggtccttgattaaatctatcctgactcctggtaaactgtctagtccaggactgaagcccataaaagggattaaggctagacagatagatattgagaatcctccatggagatgattatgaaggcccagggagtagatttctctcaaagaggaagaaaaaaacagcagaggcagaactttagaaaaggctcacatttggcagatggtagaaagaggaacctgtgaaggaaaccaatgcagaagcaacagtgaaataaaggaagcagcatagtgcagaggcacaaaagctgctgcaggtgaatgtttcaaaagaggggatgattaaatgttcagagagagcaaaaggtataaatcctaataaatcccatttgatttgggggttgggcgataacatcgtttttcatcaa

SEQ ID NO: 339057 - DNA, 307 bp, Homo sapiens
aaaatactaaaatttgccatcacacttagtggtcaaagactgaaaaatttatcccctctgatcaggaacaaaacaaggatgtcatctctcaccactccttttcaacactatacggaggttctggccactgcaatacagcagcatacagaaatcgcatatggaatagaaaggaagaaataaaactgtttctggtttgcataaaacataaatgtctgcctgaaaaattccaagtattctaggaaaaaagaaagctcctcaagcaaataaatgagtttatcacatgtggtattagtgagaggacaaatac

SEQ ID NO: 339058 - DNA, 915 bp, Homo sapiens
gtgaggccagtgagataactttctgctgacaccccacagcatcctcgttccttctgccggacttccagatttctatttctggcccaaacctctctcctgaacatcactccatggattcgtctacaaccacttctagtattttcttccacagccagggaagaagtccataaacagctcccggctacatcatacttaggacgcccagaaaaatgtatcagtatatcacatctcagggaaaccttttattgactctgtttaggtgatgtgctcaacaataattcaccacatggcccaggagccaccaccctggaccacaaaccccatagcagatgcagtcagtacctcactcatatacccttggctcactccaaaggttacctgcagatagttcctttatgacccggtgtgtctgtctgtcggagggagttctttagcccctagagtcagcttggctgacatgcagggcaggctggaaatgctgtggaggtaacaactcaggagcaagccacatccggtgaggaaaaacaatagaggacagataatcctgttccttacccttcagtgggataattttgaggtgtgttctccacagttttgcagaaggcttagagagactgagtcacagttgtcctcagtggtaacctgctcattaatgcatcctttatttggttttcctcctctctctgacttcccttccccctcactgtgttttctgggataaactcccaaataaactacttgtaccaaaatccttgccttgggatctgctttctgggaaatcaaaattaagacaacccctgtaaagggaggaggccatcttcctgagtgccccatcaagaccacagggaccagggggagatcttagaccccaaaaccacattgtgacaatatctttgctgacatcccactttattt

SEQ ID NO: 339059 - DNA, 746 bp, Homo sapiens
gtgaggccagtgagataactttctgctgacaccccacagcatcctcgttccttctgccggacttccagatttctatttctggcccaaacctctctcctgaacatcactccatggattcgtctacaaccacttctagtattttcttccacagccagggaagaagtccataaacagctcccggctacatcatacttaggacgcccagaaaaatgtatcagtatatcacatctcagggaaaccttttattgactctgtttaggtgatgtgctcaacaataattcaccacatggcccaggagccaccaccctggaccacaaaccccatagcagatgcagtcagtacctcactcatatacccttggctcactccaaaggttacctgcagatagttcctttatgacccggtgtgtctgtctgtcggagggagttctttagcccctagagtcagcttggctgacatgcagggcaggctggaaatgctgtggaggtaacaactcaggagcaagccacatccggtgaggaaaaacaatagaggacagataatcctgttccttacccttcagtgggataattttgaggtgtgttctccacagttttgcagaaggcttagagagactgagtcacagttgtcctcagtggtaacctgctcattaatgcatcctttatttggttttcctcctctctctgacttcccttccccctcactgtgttttctgggataaactcccaaataaactacttgtacca

SEQ ID NO: 339060 - DNA, 793 bp, Homo sapiens
ctacagaatatcaaaatcaaagttcataaatcacttgagcagaaaagactgcaatttgtttagcactgacctttcaaagcatctcagcacttacgcacaccctcacacaacaaagtttaattttctgacgcaccaaaccgggtcttcatctccaataagttgtgtgtacctaaaccaattattcattctttcactgcctgctgcacactgctctaagggtaatacacacaatagcaaaagacataaatgtttatgaaatccttttaaaatctcatttaccattgaagaagtactaaactaccattggcaaagaagtactaaactacagtgcagaaaatacccatgctccatgatcaactaataagtgcagctggctgggcctctgtccttttcctcagtgctagttgactccctttcccaaaccaaatctgaggtatccttacccccaatccttcctgccttcaccaacaaagatggccccaaagtatggacttctgcctctgcttctccttcccacctaagtctactaatacaaactctttatcaggactgtctaattttttcctattctctctgataaactcacctctcccccactaaatcctccccattggccaaaaaaataacataacaataaccaaactattcagtctcccatccttaaaaagaaggagaagaggagaggagggaagggagttcctgtaagttctcactttgaagatacggcgttcccttgtccatctcagccatgtctcaagagaagacccagtgccacctgctgccaccatcctgt

SEQ ID NO: 339061 - DNA, 658 bp, Homo sapiens
actagatggcagcaaccaaggattattcctgctaaagatgtataaactgaatctaaccaagcctcagacacaattcccatttaacaaaaaaatgtaagggaaagagggacgagttacataactccatcaggaaaaaaacagacagataaagaaacaatcaggacattctacagaacaaccggcctgctagggtgaaaaaatcaatgttacaggaaaaagaaataggtatggggtgtaggggcagtttctgtgctatagcaggagacataacaactgaatgcataccaactcaactatgaatagattctgaacggtcccacagtctggggatttttgaaaatggaccattagaatgtcagagaattcgtgtttattttcttaggtataatagtcttaaagtggtacaggagaatatccttattctccacggatgcctaatttaggggtaaagcatcctgatgtctgtaatttactttcaaagggttcaacaaaaaaatccagaattacgtatacacataaagcaaaagtagcaaaatcttaacaattattgaacctaagtggaagatgttaactgtactaatctttcaacttgtatgtttgaaatttcacataataaaaagaggggtggccagaagcgcgtggccagaagcctgtaatc

SEQ ID NO: 339062 - DNA, 777 bp, Homo sapiens
gagctcggtacccctgacggaggagagggacggcagcctgtaccagagctctgggtaccgctatggcactgtcataaaagacaaagcaagaaaggatgggtatctgttctgcttaaattatttgtcctttagtgaggggtaaggggatcctagttgaagttatgagaggtaaacatttgatacaacctctctgtgcctttttactgtgcagtaagatgtgtggtttggcttctcagatgactggatggtgatgctatattggaactcttgattctatgtgtcagactccaccctcgatcacccaaggcagaagagggattgatgtgttggcctggagtcccaggaagatcagcaacagagagtgggcagctcaggcctccggcagcaaattaacaggacatgggcagcccagaggcaaagtgacttccccattgtcctggttgtaaaggctgaagggtcatgatgctgatctaacattggtaacagctggactttattgagcacttcctgggtgcctggcagtatttgttttcatcaaccttatgagatgggtcctgccataccccactttcctgatgtgtagggactcatcgacctcctcaagatcatatagttacttatttgtggctgggcatgatggcttgcacctgtaatcccaacactttgggaggccgaggcaggaggattgcttgagccaggagttcaaggtcagcctaggcaacatggtgagatcccatctctacaaaaaaattagccaggtacagtggtacgtgccta

SEQ ID NO: 339063 - DNA, 464 bp, Homo sapiens
cagagttttctaactgtgtggttattttgtagacccatagtacttttagagctggaaggtacctttgtacttgcttggtttgatgaagaaactgaggcccagagaggtgacatggctatgcaggacacacagctggttagaaagcacagaatcggtgggtgcttatgtgtctacatgctcgatttccgcttgatctgatctgtccatcacaaacacagattagagcctgggactcgggtcaccgatgcttggaaatgttattcgggagtttgtttatgttgtttttcctttggaaaatggtgatttctcattttgattgaggactgaaatctcagaacgttccttgggcagcacagaaatatcaaaatgctcttaggagtcgcgtgtgtgaacactgaggcccgggtgactgttccattcgaagggttagctctacttcccatttttgggagtagacttagtac

SEQ ID NO: 339064 - DNA, 215 bp, Homo sapiens
atgtacgagcctgtctgaggcattttagacaagggagaaggtgcctacacaagtaccaaacaatgcagtgttaaaactgctttccataggtggcaatcttctatgatgcttaagcattgtaaagcagtgacatttgttcatgtggacataattaaaataattgaggccgggcgcggtggctaatgcctgtaatcccagcactttgggaggctgag

SEQ ID NO: 339065 - DNA, 328 bp, Homo sapiens
aatttgctagactttctgggaaagagaactttgatcctaatgaatttttttaaatggccccctcattcccactaagagagatctttcatcaacctccaggaggcatgccttgggaaactcgccctaggatagaagagtgctgaagagtatctgggctctgtcctggattgtgtcctaaatgttagtgagaagacccatttttgacttgacattggataggatcactaaataatcctgacatgcaactctggggtaatttgttccatgttctcaagcaaactaagtcttaaaaaagcaagctgctcctttgggaacctcaccaaaaagc

SEQ ID NO: 339066 - DNA, 401 bp, Homo sapiens
  misc_feature (318)..(318): n is a, c, g, or t
  misc_feature (320)..(320): n is a, c, g, or t
  misc_feature (368)..(368): n is a, c, g, or t
actaagaaatctagaggcacaattttagaagagaaaaaaattctatccccttaggaagtatttttacactgaaaaaaactaacctaatattttaggaaaatgtaaatagattcctgaaattccactgccaaaaatttaatgaggcttacagttttatggacaaatttacgttaaaaactgtgatctgaagatcaaacaaaggagtagggtgtaaaagaaaaccatgccactagaatcactagattttccttttgcataaaaaaaatcatgccattaatgtgtggaagcagcgaacacacacacacttctcggtgaatntntacttcctgctgacatttcttccacgaatttctcaatactggcagtanaaacttatgatccttgactgaccgttcgctgtt

SEQ ID NO: 339067 - DNA, 410 bp, Homo sapiens
atccacgggtaagagaggtcatgagtttagtgcaacctcagtattcaacagctgcaacatttctaaacgcttactctcagtattcttctccttgtcacagcttagtaacaaaatgtttcctgagccagcacactcttcacactacactttgagtagcatggctctatggaacagagataatggatttaaattcaacaacatccacatcttccttcttggagtagaaggttgttctaggcctgacctctcccagggagctacaggggaagtctagttggcatggacacctttgagcagggagggcagaactttctctctgacagaaaactgttacttggtaggggacttggtaagttgaaggtataggaagtgttataaattcctttgaccccttgctattctcactagag

SEQ ID NO: 339068 - DNA, 122 bp, Homo sapiens
ccatggggcccacaccccgtctccatccatgtctgggtataagcccttcccaatggagcctcttcacaaattccacagcaccagtcactgtgagatggaatttaagtgacatcagagggcct

SEQ ID NO: 339069 - DNA, 461 bp, Homo sapiens
tgtttctggccatgtcttttggtgggcatatacactcatttctgttgagaatatgtctgagtgaattggtgaattataggataggcatgtcaagctttagtagcttgttggactttattataaaagcaggatttgtactttagaaagatcattttgtatatggatgagtggttgaagtgataagactagaggcaagtgagactagttaggtgcctattactcatacccagttatggactgagatgtaaattaaggcaaaggcaatgaggctgaggaatgagaatgaagtgggacgatataggagatggaagaggttggattttggggggatgagggagtaaggatgatctgtacatttatgacttgggtcattaagtcagaggctagaaaaggggtgagcttttagaggaataaaatgaatttccttatgtatgtgttaaattagagttgtctgtgaatta

SEQ ID NO: 339070 - DNA, 144 bp, Homo sapiens
agtgagaatatagtatttggtgatatgtggatgttaggaatgagggagaggcagaaggaaaaagattcagggaagccacatagatttctagcttggatgactaggtacatggtagtgctaactggggaaaatgaagagagaata

SEQ ID NO: 339071 - DNA, 349 bp, Homo sapiens
ctttattttgaacatttacatgaaataaatgaatgcattgctaattgttaaccagatgagaagaacatgagtgagactgtataaagactcagtggaatgcatttgactgaagatgatggtcaatatgagagttaccaaacacagcccttccctggtttaaatggacagtgtgcagacgtttcctctttttatctgtcaaaaacatggacgctatcaacgtgcttcatgtgatttttagagaactccatttaataaaaaggcatgtcccacgaaacacagagaaatccccttataaccctgagttcagaggacaatcaacatcttcaaggaaattacgcgacaccaatgc

SEQ ID NO: 339072 - DNA, 445 bp, Homo sapiens
tagaggcagggtttcaccatgttgcccacgctagtctcttaactcctgagctcaagtgatctgctgcctcagcctcccaaagtgctgtgattgcagtcatgagccactgtgcccgacctttttatctatattgatttttgacattgaaactaagctctcttggttttaatgttattctgttattcagtcattcagtgatatggtttggctgtgtccccacccagatctcaccttgaattatgataatccccatgtgtcaaggatggggccaggtgagataattgaatcatagcaggtggtttcccccatactgttctcgtggtaatgaataagtctcatgagatctgatggttttataaatgggagttcccctgcacacgctctcttgcctgcccccaggtaagacatgactttgctcctcattcacctgcctctatgtcatttt

SEQ ID NO: 339073 - DNA, 416 bp, Homo sapiens
cattcttgtattagtttcccatttatgtgcaaccaattactaccaacttatcttggcttatccaaatattctgcttagggtctctccaggatgtaaccctgatgtctgctggctgcatactcacctggaggcttgattagggaggagtcccggtgagtctcactgaggttgacagaactcatctccttggactgtgtgactgagaatactggctctcccagattgatggctggagactgccctcaggtcctagaagccactccagttctctgccacatatgcaattatgacacagcagtgtgcttcttccagattgggaattgttatttacccacaaaagttcccagttctcttttaagggctttcatccaattttaagtaagatccagtcaagataatgtcccttttgcttgacc

SEQ ID NO: 339074 - DNA, 222 bp, Homo sapiens
ggtaaaatagacatttttactgtgtgaacaatacaaaatgtaaaggaatttagaaacaagtcaactacaccacattaaaaaaatgcctgaattaagatgaaataaaagtgatagcagagtctcttttatagtcagggaaggctccccaaaccttggtgaatggaaacatggcttactaggaaccaggtctgttcttggttaaggctaaggttggatagggag

SEQ ID NO: 339075 - DNA, 355 bp, Homo sapiens
atgatgtcaaagttggcatcccaaaattcctgagcgatatttttcaatggttgtacagaaagcatctttctgttaaagttgtcgtgttttatcttgtttttaacaaagctgagacaaattttcccactgactttcactcacagttcaaaaatgtgctcttacaggaaaacctaaaagaggggaagggaaatagcctccagacacataaacacacccgagaagtcagatgaattctatttaacaacaacaaacaaattcctaagtattatactctataaaggcagagtgtcctggaaatgccatctggtgccgtgcaatctggattcctgtgagtgccagggacaagtggctgaac

SEQ ID NO: 339076 - DNA, 455 bp, Homo sapiens
agtggatgagactaatggcgaagaggacagagtgcttccatgccttcgggatctttcaaatgatggagcaaggctctgcgctcacagctgcaaggcgctaagggacctgagactctgtccctgccatcaaagaccttgtggtcaggaaaagatgtcccaaatggttacagctcatggcaggaacaggggagaagcaacttctgggtagcgagatgagtgttgttaaaaaataaataaggacccacaggcattctaagtagggaggcagagtgtggcaagcaagggggaacatctgtgaagatttctgggaagaggcggcattcaagatgttccttgaaggatagataggatttccggagctggagaggagaagctagggcaagaggcccgttctgggcaacagcaaggtcatggggcaggtcagagcagaacacagtgtcctggggcagtgggag

SEQ ID NO: 339077 - DNA, 198 bp, Homo sapiens
aaaatatgtgttgattagatcttggagtgggaaaaactttcttttatagaaccacagggagaaattgcaaaagggaaattaaacagaattaaaaggtaaactagaaaaagacattaacaatatgttggacaaagattaccattcttgttatatactgcttttagaagtactaagaaatgaaattgacagacaacatca

SEQ ID NO: 339078 - DNA, 566 bp, Homo sapiens
acatgttttatataacactccctataatcagtggcctgtatttacagggtatgtaacttggagtctacaaactgtggtagaagacagtgtttccatgagaaacaattgtttttcaaagactcatcttagtatattcagacacaaatagttagaagagctcagaagcaactaattacttaaagggcctcaaggatatttctggatagaatgaaaataatatatgtcatgaactgaaattcttcccatacaaagaaattccagtttgactacctttaaagtatttagacaattacaagtgatttaatactagtttcaattcaagataaaacttggttatgtaattaaatgcaaacagagattaagtataaaaattagtaaaaatatgttcaaatgtgaatcaaaacaaaaacaaaaaatagcttcttaaaatcaaagacaacaacaataatagaaaaataccttgcagttctgtagcagtcgtatgagatgttcaaagcaattgctgttaagaaaaatggcctgaagaacaggtctatctgtacaatctaacatggctgtgatggtat

SEQ ID NO: 339079 - DNA, 366 bp, Homo sapiens
gcaggcatggtggtgcgcacctgtagtcccagctacttgggaggctgaggtgggaggattgcttgagcccgggaggcagaggttgcagtgagctgagattgctccactgcactccaacctgggcaaaagagccagcccctgtctcaaaacaaaaaacaaaaaattaagctggaaatggtggcatgcacctgtgggtctagctacctgggaggcagaaggatcgcctgtgcccaggagttaaaaaacaaaaatgcaaatgatgctagaaagtttctttaagggttagagagctaaccatttaaggttcaaaaactaatctggctgcatgcacttatcattcagtaagaagtccctgagaacctctgg

SEQ ID NO: 339080 - DNA, 383 bp, Homo sapiens
taccttccctctgacacaatttcccattgagttgatgctttctgactagctgtacaaacgcctcctccaaaatgttgctgcgatcctaagggaattgtgcaattcttcagaaaacccacacattctcctaaactgtccactgactaaaagcattctttccttccagatgggcattggtccctgggctgtacaggcagcccaagaattgtggacactcccagccatgccagagagggaagggccatcttctctttaacctttaagatttggggatgtcagagaattaggatatttgagcatgagttttggagccagactcactagggttcaaccactcgctagcttttaaccttgggcaactcatttaacttcttgaaatctgt

SEQ ID NO: 339081 - DNA, 122 bp, Homo sapiens
gaatagtcttaagactcagaaaacagggtagccaacggaaaaagaggaagggccgggcatagtggctcatgcctgtaatcccagcactttgggatgccaaagtgggtggatcacttgaggcc

SEQ ID NO: 339082 - DNA, 200 bp, Homo sapiens
gcagcacaggagacagaacgtcttctcaaagagttggagcagaatgcaaaccacccacaccggattgaaccggatagcttgcgctatcaggtcaattctgcagtctcagtgtcttcccaaataaattatagacatcaaatgtctggtgataccaaaaactacttgtaccctaaaagtattgaaataaaaagtacataaat

SEQ ID NO: 339083 - DNA, 259 bp, Homo sapiens
ctccacctcccaggttcaagcagttctcctgcctcagcctcctgaaaagctgggattactggcgcctgccaccatgcccggctaatttttgtatttttagtagagacggggcttcaccatgttgcccaggctcgaactcctgacctcaggtcatcctcctgcctcggcctcccaaagtgctgggattacactgcgcctggcctgtaattgattttttacgccacatctttctggacactgactatgtcatacaaacact

SEQ ID NO: 339084 - DNA, 237 bp, Homo sapiens
tcatcgagctcggacccttagggatcttattaaaattgcaacgcatccctcctttaatacccctaatctttttcttctcagtacttattaccatctccagcgttatctattttgtttatctggctagaggttactctatatgtaccgtttgctgtagctgtaggtagcagaagttaaactttcctgtggtatccttatgttcatatcctctgttgtccttgggtttccctagagaca

SEQ ID NO: 339085 - DNA, 846 bp, Homo sapiens
taggcaaggccagaggcagagagggatgcaaatggtggtgtcagaaataaaaaaaaaaaaaaaaggaaaacattggaaactactcttgaattgatttaggtgggaaaagatggaagactttgaggaaggaaaagacataagacctaagttcagagcccagctgagatcaagtattcatttgtaatgaagcaagttgccatttccggagtgtccagcagcctgggggaggagaaggaatccaatgggttagggtcagaattagaggagttccggatttagtaacatttaaagagctgtccaagggtcccaagctgggcaaggaaagcccaagcgatgctgacagcctgagagaatataaagaactgaacgtcttcataagagttttttaaaaaaataaaagcagatattccaggggtaaggaaatgacagaagtggcgaaagagcaagttggagctacaaggtgggttgtcctagttctttgcagaagaaattcaggctctaagggccaaggtataaccaaggtgatgggtgagcgttgtgctgttggtttgtctcaggagactcttaagtcccatgagggcagggattatgcagctcgccttctttacatctctagggctgagtgcagtccctggcacataatagacacacagcaaacattggagggaaccagcggctagggtagggtggaaactaagatcttggtgttgaggcattcaggtatctctaaggtgaggatgctggacaggtttcactgttacagtcactgagggaaatcacaggagacctagtaaagagaagtatagagacttgtattaaaatgatcaagaattgtgggaaaacttc

SEQ ID NO: 339086 - DNA, 311 bp, Homo sapiens
acattttgaattttggtgtcacaatttacatcttattatactgcatgtcctgtaacaaattattgtagttattatttttactaatttagtcttttaacctttcttctaaagatataagtgatttaaacaccaccattacaatattagagtattctaaatttgactatgtacttttaccaatgagttttatatttatagatgttttgtgttactagcattaacacatgtttttgtattattagcattcttttattccagcttgaagaactccattaagcattttttttaacacaggtctggcaatgataaac

SEQ ID NO: 339087 - DNA, 156 bp, Homo sapiens
tcttcacgtttttgtgaagatcctatgccattcctccatggccatgttatgattactgattccacttagcagggcttctggtattgagatgagggtcacatacaggatggggggaggtaacattaagatttcactgaactattcactgtgtattag

SEQ ID NO: 339088 - DNA, 288 bp, Homo sapiens
gtgatccgcccgcttcggcctcccaaagtgctgggattacaggcgtgagccacctcaccttgccgaggatgtttttttagagctgagtaggggaaaaaacatcataaccaactagccaaccaaagatccacaacttacaggataacgtgtgtgtatcttcattttacaccgtggtctttgaaaacaaaatgtgtgtgtgcatgtgtgtgtgtgtatgtgtgagatttttgcttgttgttttattgtttaagacactttgacagagggattacgtgcaaaacattaaca

SEQ ID NO: 339089 - DNA, 491 bp, Homo sapiens
ctggacccagttagcagggagaacacgtgtgttttgatgacagactatgccaagataggtaatggatggagaagaaatttgggctttagagggggatacatgattcccctttgagaatagatgttgaaggagcaggagggtatcctgttgggaagattcataagaggggatgcagaggagaaggtcgtccacatattgaataaggtgagaaacagatggacagaaagaaagtaaatcatgagaaagagcttgactaaagtaatgggggttgtctctgaagccttgtggcagtacagtccaggtaagttgctgagattggtgggtgacaggatcagtccatgtgaaagcaaaaagaggtcgggatgaggggtgcaaaggaatagtgaagaaagcatctttgaggttgaggacagaataatgagttgttgagggaggtattgaggataggagagtatatgggtttggcaccacggatggataggttagacaat

SEQ ID NO: 339090 - DNA, 130 bp, Homo sapiens
catcatcagatgcctgcgggtgaaggtgggcccgctatggccagcgtccctttttatttttatttatttatttatttgagatggaatctcgctctgtcgcccagactgtagtgcagtggtgcgatcacgg

SEQ ID NO: 339091 - DNA, 683 bp, Homo sapiens
gggctcttttttggttccatatgaactttaaagtagttttttccaattgtgtgaagaaaggcattggtagcttgatggggatggcattgaatctgtaaattacctttggcagtatggccattttcacgatattgattcttcctacccatgagcaagggcaattaggcaggagaaggaaataaagggtattcaattaggaaaagaggaagtcaaattgtccctgtttgcagacgacatgattgtgtatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaccagttccttttgtctagtcaaggtgatctagtagtcttcactttaaatcattcagagatttcttaaaaagttattaaaaccacacacttaatttcatgtttgaagaccttattttgctatgcacatctttaaccaagcaagccctgtgtcctcta

SEQ ID NO: 339092 - DNA, 156 bp, Homo sapiens
accccaaccccactgtaggctgaggcagaaatgctctgacgcacacaaggttctccattctcagggccaccctcggcaccacagctgccttgtcaggacctgctcaaagtgagaactcccgtgcaggccttggggtgacccaccctggggtgcaga

SEQ ID NO: 339093 - DNA, 439 bp, Homo sapiens
gagcaaagggagtctctcgccccgcacgtactgtgtgcctcgttctttatctgtgttcgtttattcactcctcatgtcagcctcgtctccactcgacaggggggatattccaccccaaaccctgcaggactgcctcccacacgggttctacgtccaggtggagggtagatgcgggtaggaattgtataatatttgttagaattctcgggagtgaaaaggtgttagtttagaaagtaggatgcctgcggggaaacagaagtggtgggtacagcatgaaaaagtgggccttttggtttgcccggctgtgcgggtggcccggcagcgagggagcgcggttatccacgagcagaccgcagagctagtctccagccattgccgatagctgcatcacctttcatcattaactgaagggaacctatccagaaaactattttacatt

SEQ ID NO: 339094 - DNA, 660 bp, Homo sapiens
aggcagtgcagctctcctctgggtatggccagccggggggcccggagcccaattttcatggcttttctcagcttcagatgtagtgtgtgagtgaagtgggcggtatgtgcccatttcatggaggcagggcagaagggtgaaatactgtggggaggtgggagctggatggcattccagctcagcctgtctccatagctaagcctttcttccctgaagtcagagagagaacgcttaagattgggcctaagcctttatgagtggcccaaaaaataaactcagaggagtcaaggtaacttgggctagtcagttggttaatactgatattctacgtcatttggttaataatgatattctaagtcagttcgttaatactgatactcttaagtcagttggttaataatgatactctaagtcagttggttaataccgatgttgtcaatcagttggttaataccgatgttctaagtcagctggtcttgcactcctgacctcaagtgatccacccacctcggcctccaaaagtgctggggttacaagtgtgagccaccacacccggccacgacgttgtaatctctcccttcccctgctcttcccagcccatcacaggtctgctttctgtccgtgtagattagtttgcattttctagactttagtataaat

SEQ ID NO: 339095 - DNA, 458 bp, Homo sapiens
attctgcctgggactggcaaagccaggcaggggcacaagaagggggccatgagaggtggcaatgacatcccaaacaagcttccaggtttagaagggctccttctttcccagagcaggcaaaacttttctcactctggttgcggggtgaaggaggagaaaaggaagaggcctaagagacccaacggctaagaggaattttgattttctgtatttagtggcctccactccccactgacaaccacacaggagccttggattccacaaaggagaatgaggctgagagcttccagttgggcattaggaatttaaagcaggccaggccagccttggagaggtggcacaaagcagccagtgtcacaggcgctatgtggcagtcagcaggtttggactcctgcacccagagttcagtgtcaatctgacgacaggccctctttggtgcttgaaggtccaagtagagg

SEQ ID NO: 339096 - DNA, 418 bp, Homo sapiens
agattctacagggaatgaaaggagaagctacaaggaatgaaaggagaaggaatgaaaggaatgaagggagaaggaatgaaaggagaagctgactggagcaaacactagttatgaaaggattccctatgaagtgagacttgagatgaagaggaagcagcagattccagatgaattttagggttggaacccatatattaccttcataaccagagagcctggtattcttgattcttccactatagaccactgatgtggtttgagaagagagtacagaatgacaccactttcaacaatacccagaggcataaattgctccaaagctttttatcaggcttgaccgaacacggtggctcacacctgtagtcccagcactttgggaggccaaggcgggtggatcacatgaggtcaggagttcgag

SEQ ID NO: 339097 - DNA, 660 bp, Homo sapiens
tgggattcaattatgatgctgcagaggattatttaaagctggtcctcagtgacctgctggtgaggaaagagtaattcatgctacaaatcctttggaagagtagataatcaaaaagctaatttcttcattgctgtagaacacatgttgttattttgcagatttaacttccgaggagtgtttggtttagagtaacattaaaagaaattgactttctctgaggataagccatctaaccataggaaaagggaagggaattttactacaaaggtagctctcttctttcattacttctctttgtttttggactatttgttctctccacaattaagactataagttcctgggaagtggggactgagctccgctgagctgtttcccataatgccagggacagggcagccgttcaataaacacttggagaattacaatcgtttggtactatgtcctaatcttgggtggatatgcacatgaagaaaccaatattttttttctctctctctctctttttgtagaggcagggtcttgctctgtcacccaggctagagtgcagtggtgcaatcagagctcattgcagccttgaattcctgggctcaagcagtcttctgcctcagcctcctgagtagctagaattacagggatgcaccaccatgcctggctaat

SEQ ID NO: 339098 - DNA, 282 bp, Homo sapiens
aactggaagtcaccttagatcacacaacctatttgcgttctcacaggggagggatgggaaactgtggaggaaaggaatctccggattcacttctgtggggtggctcacatggctccctgtagcctgcaaggaaatgacaaaggtggggtttggggtcctgggcctgagcctggggcttgggtactgattgacagctttactaatgatttatttttatcttggatcagaggcttttagatgctctcaactccaacatcatggcaaacccctgtgtgctgagct

SEQ ID NO: 339099 - DNA, 296 bp, Homo sapiens
cctcttttgggggtctccgcggtgtcaggacttggagagcctggtcgtgggacttgatcagagaggccttgagtgcagtgggtgcttatctggtgactgtggccctgaggtctgggacagacactgccagtctttctgggccacacccacggggactgccagcccccctgggcttggcacagtggaggggagcctccaccacagtggaggagagacacacccaaggccctggatgtgcccggctctctgcagctgtgggtgcctcaggccggccgccgatgggtctcagtttctga

SEQ ID NO: 339100 - DNA, 443 bp, Homo sapiens
cccaatcctctatctgatgaataaaaatcccccactcagtagcaacaaaaagtggccagccagcatctacttccacatctgtaataatgacaacccttctttcaagacagcctgtctgcagagagcaaaatattaattaagaaatgtttttatacgttggactgaactcttccccattcccctaagtatccatttcctggttctaacaagcgtctgttcttttttccaaaaaacaaccttttaagactatggcactcttctaaaccttctctttttcaagctaaatagtctcagtctttgaatcattctttagataatatggtttctgaatctcctaacttttctgtttattgtcctctgggcctatttccatttgcccccctcactcttaaaagaatgacaataagctcagttccaggtgtgacccaatttgggcgtacggc

SEQ ID NO: 339101 - DNA, 110 bp, Homo sapiens
tcaactctaagcacataaaggagcatagcaacaaagaccataccctttgaagtgtgctgttctctctctctctctctttttttgttttgttttgttttcaggcagggtct

SEQ ID NO: 339102 - DNA, 256 bp, Homo sapiens
aactgcaagtcctgggaatctttacacttaacaagaccaaaactgagcttcacattattatccactgtgcaataaaaaggttaccacagaaggcctgaggctgctatacttagaaaggcctgcttgcaaggttggcccttggttagtgtctagaaacttggatttttggagggttcccaccattccctggtaatagtggctcactgtgcctagactgtacaaacaatgcaatttaggctgaatacctgctttcttc

SEQ ID NO: 339103 - DNA, 230 bp, Homo sapiens
ggtcttggctccgtcacccaggctgaagtgcagtggtgtgatcatggctcacagcagccttgaattccttagctcaatcgatcctcccacctcagcctcccaaaatgctgtgattacaggtgcaagccactagacccagctgaattatggatttttaaggctgctttatgtcaaacattgtgggttcttttaatattgttttccagatttaaggaaacttttttctttta

SEQ ID NO: 339104 - DNA, 746 bp, Homo sapiens
aactccaacaatatcttggcatcatgaactatgatctgaggctggtctgtgacacagtaacagaaacagaaaaaactcagacatgagctgctcatctcttcactctttcctacatttttgcacccaaccctcactagagctaaatctcaactgaagagtctctactcatccacacccgcagatcagggcccctttccaggtactgctgctagtttctactctccacagcaccgaataaagcacaatctatgtctcagatacgcgactacacatttaccaaaacgaccaggacaaagaacaaaaaaagcctttgcatccaggccagttgctatagagtctttgaatattcccaacctgccttctctatcatctaactactttgtagcgacaggctggaacaagaagaatggatgtgctgtgagcaggcaaggtgagaagtggagaacaagcggcgattgtactgtagttaattattttaattgagcatgagaagggaaaggcttgaactctaaggacgttggcagagccccagagtttatgtaaaccaggaaatgcctctagcacgccccagatagcaggagcaactgaatagaagtggcccatctgctgatgcaacagcgctgcaaacaatggctgctctgagagagggtcagttccacagagttttcagaggttgtacacctctttgttcctgcatgctcacaggctgtgttagaagcctggaaatcccagtcaaatgatgtcac

SEQ ID NO: 339105 - DNA, 125 bp, Homo sapiens
gagtgcagtgatgttctcagacaaagtcagaccgcaggctggcaatatgtcaagctcatctgaggcaaattccagtttgtcatgggaaaaaaaaagtgttcattttcttctgggattcaatgaat

SEQ ID NO: 339106 - DNA, 458 bp, Homo sapiens
gttgaagctctgcccctctggtatcctctgtgggcaaggtagaaaaccgtaaaggctgagaaattactgttgagagactcatggatccaactgatataggaaatgcacatctttgcatacagcctataattcaccaacaatttctgcagagaagtattaagattgcactacatttgaagtatcctggaaggtattctagggattctaaggctatacagttcctgcccttcccctttttgttgccattttaaaattatttagcactcctttgtcattcaaagaagcagaattcaatttaaatggttcagaaaattttgaggaacagacggctatttagaggtgtaggcatagtaaagtgaacctacaggcggtattaaggcacccagagattagcaacagcagcaagccattatcacctttaggtctggaggggactagaggggaagtgttactggagc

SEQ ID NO: 339107 - DNA, 307 bp, Homo sapiens
ccccctccccgggtacggtagctcacacctttaatcccagcactttgggaggccaaggtgggttgctcagttctctggcttaatgaaaatttcaaaaaacatattttcctttgcattttgaatctgactttgtgctggggattttgtttgaatttaatgatagaccaaaatgcaattactgtacacattaccttaatgtgtgtcagtttaaaatagttttatattgtcatagattttgtggatttatcttggtttcttataccaagataaattcttaccttacactgtcttttactgtctcttaccc

SEQ ID NO: 339108 - DNA, 412 bp, Homo sapiens
tatcatacaacatacatctgatactgtccttacattaccatgaaaaacactttgagaaacatgtcattatttctgcattttacttataagtaaacagaaggtcatcaaggttaagggggtcacctctcaatgtcacacagctaacaggctgtcaatttaggaactgaatcaaagttttcattctctaattcagtgatctttccacttcattacaactgcttttaatgacattggttgtattcagcattagaaaaggtattttgcatatagatgttattgtgtaagatgactaccacttgttttaagtatttcatgcggtaattatgaaaatagttttatctacattcccatcagaccataccttaaaattaactgtaaggctactctttaattatatcaagtcataaatact

SEQ ID NO: 339109 - DNA, 363 bp, Homo sapiens
aaatcaattaaattatataaaaccatcatggtgaactataaattaaactgggaccttgatgaatgattgtataagagagatgagaatgtgctagaggtgaagaatgaatgcaagcagagaatccagtgagaatcaggaatagtgaatatttcaaggaacagtgaatatttaatcttgcttagaatataaagcatcactgaaaagcttttaaggaagactataatacaactgatatcagagtgcagaggaattgagatgctagtgtaagaaagatgaaactcatgcaataaaaaaggaatcttggcatgtattagtttctcattgctgctgtaataaattgtgacaaacagctgggcacggtgg

SEQ ID NO: 339110 - DNA, 330 bp, Homo sapiens
ctgcttccaggtgccgcggacttgtgatgataaaaataattgccatttattgagcacttactgtgtacctggccactgtggctctcacagtgttacatgcattaattagctcatttgatcttcacaccagcctttgaggtaagtatccacgttttgcagatgagaaaactgaggtacagaaaggtagagccactcattcaaagtcacgtgacttctaattagaagagccgggattggaatccagatctgtgaacccctacccagtgctgtccagcagggctttatgatgatgaaaaagtcctctgtctgcacagttcaatagggtaacta

SEQ ID NO: 339111 - DNA, 158 bp, Homo sapiens
gccagcgaggtttggctggagtgacccagggggcagcagtgagactgcagacattggcagggggctggttccggaaggtgctggggaaccgtggggcggtgtgaagcaggcgggttgtgttagacactgtgcggcttgaagggtggactgggaggtga

SEQ ID NO: 339112 - DNA, 83 bp, Homo sapiens
tccccagaatttttattgagaatttgttctcaataaaacatttgggaaccctctgcctaacatgtaccaaaatttcagattcc

SEQ ID NO: 339113 - DNA, 214 bp, Homo sapiens
cctaactttatttaaccaatttcagagtcaacttccatcttaaatggatttctagaaacagttccagcctaaagagacgggaagctaaaataaaaccaacaaaggctgagcatggtggctcacacctataatcccagcactttgggaggtcgagaatgaattttttttttttaaagggaacctttttttattgaggctgttaggtctacctggg

SEQ ID NO: 339114 - DNA, 568 bp, Homo sapiens
  misc_feature (109)..(109): n is a, c, g, or t
  misc_feature (116)..(116): n is a, c, g, or t
  misc_feature (118)..(118): n is a, c, g, or t
  misc_feature (132)..(132): n is a, c, g, or t
  misc_feature (136)..(137): n is a, c, g, or t
  misc_feature (139)..(139): n is a, c, g, or t
  misc_feature (192)..(192): n is a, c, g, or t
  misc_feature (200)..(200): n is a, c, g, or t
  misc_feature (279)..(279): n is a, c, g, or t
gggagatgtttctccctgtcatgtacattcgatgtgtcttttattcagagcaaagtgtcttgtattctgaaactggaaactgaaccagtttgtttctcctagtcaccangcatacncncctggctccccaantacnnanatgttctcatctgtcgcacccctgtatttgcctcacccctgcatggtcggaantcttcgtntcaggtcagaacagcctggggtctgtgggtaaaatcagcccttctcccaggcctgtgcacacaccccctcagcactccntgtgcgcgcactattccattggtgtcttagaattgtcctgacacccttttcatccctgaggttttcccactacaaggcaagtgcatcatggtaagagaagggtcagaggaagagttatgccattttttttaataatggaaaaagccatggtggaaaggaatttgaaaacagaactgggcgcagtggctcacaactgtaatcccagcgagttatgtgttctttatgtattctagacacaagctgcttatcacatatatcttacagtattttctcccatactatggttgtc

SEQ ID NO: 339115 - DNA, 86 bp, Homo sapiens
attgacacacagtaactatatatactgatggggtacaatgtgatgtttcaatgcatgtattacagtataatgatcaaatcagtgta

SEQ ID NO: 339116 - DNA, 493 bp, Homo sapiens
atcatgaaattggattctgttgctttaagcatttcatgactgagctgctgtctggatgctacctgaagagattctcattgaatatcattatggccagtaagtgttccataattttctttaagctccatctatgtaaatatttttgaacaattttgcacaagtacagggccacatacctatttgttataaacccgacgttgataaaatgcactcttagtataattgggtcttgttttgatcctggcagtttcatattgggatttggcagtgagttcaacagaataagcattatcctcttgaggcccatctaggattgaactaaagggcttctacaatatccacatgatcatacaattagttctctctctccctctcttttttttgtgctgtgatagtgtaactgaatatgagctggttgccagggtattgtggtagaataataccctgcagtaaacagttaatcatgcagcagaactggcttgatttgtcgacg

SEQ ID NO: 339117 - DNA, 726 bp, Homo sapiens
gggaaaggtagtaaggaacatggctagatatagagattggttgagaatccagaaagcagttggacaaggatctaccagaagtttaaaagaagtttccaacttaaaagagaccgaagccaaaagggaaaattaaaggaacttggaagaaacagagacaattcaggaagaaaaaaaaaactataatattataatatcctcagggagctaaaacaatatattgcaatcataaaaaagcaaaatactatgaaaagggaacagtcagaaagtaaatgtggcagatacaattgaacattatcaatctcttcttccttcgtaatagatgacccatattgttggaggcagtgacacactctgctaaaaactttttttagactcccttacagatagggtaaccaatgacaagtaagtagaaatatttaggtgggctttcaagaaagttatcctttatggcactgccagaacttccataagggtcttgaacttgatctcctttaagacctggactagccacaagcagaggatgcttgacatcttttagtcccagacaaggtcaaatgtggaggcactggccacatcataagcttgtaccgcaaaatgacccaccaaaaaagccattttccccaaaagtgtttcagttctacgaagtacaagtacagatatggttgctgtaactaaactgaataacgaggctgggagtgatggctcacgcctgtaatcccagcactt

SEQ ID NO: 339118 - DNA, 357 bp, Homo sapiens
tgtggggggtagaggtatgagtgtgtgttcctcacagtttttctaaggatgagtacgatcttgataaccaattttcaattttaaaaaatctgggaacacataggtatttacccaaaacagttctttcacagtatggaggacaggtgccactgacatgataaggtgacagagactttgtttcctcagctttgtgttccccctgaactggtctgagtaaaaaatccatgcccaaatccgggctctggggcgaaaccactgtttaattcagcagcagcgattaaggtcacctaaaaagattattgaaagcatgatgctagcactcattacagagggctagggttgatccctgggttagca

SEQ ID NO: 339119 - DNA, 544 bp, Homo sapiens
aattttaagaagtttttatataatcctgaaggcacccacaaagaaaatgtctgtacaggtacaaaaaaggaaataagaaagtagtgacagcctatccatacaaaaatcaaaaagacacaaaggaagatagaatgagaaacagacctacaagaatcattaaacaataaaataacagtaatctttgtcttcagaaaataaatattttaaaaatagacttgccaatcaatacacatacattgaatagagggattatataaaattttatataccaagatccaacttgcctctcttcaagagtcacttgagatctagtagtgaaatcagcctgaaagtggcaagtggaagaagacattttaggcaaacatcaaccaaatgagagcagaagagatcaaaattgtattatacaaaatacatcgtaagtcaacaactctcttattttataaaatatactttatgtcaaaattcacaagagaaaaaaaggtcattaaacaataataaagatatcatttattgaaaatgtatgacaaatatgtgcatacatata

SEQ ID NO: 339120 - DNA, 248 bp, Homo sapiens
ttgctgggggcggtagaggccagtcactggacacgatgtgccattacatagtcctaacaaccttgtgggcttgtctgagaagaatcctgcatgtctcaagccagagagaatttttcatgctcttccttgaacctgagtcatctatttcctgtacactttgtctaggactctgtcaagcatctctcagtcttaggacccctgctccaggaatccttacctaatgggattgacatcttttctatactctt

SEQ ID NO: 339121 - DNA, 209 bp, Homo sapiens
gccaataccccgtgtgaggcttctgtcaactatgaagtgagtcctctttgattagatatcaaggccaaggaaatggctgggtggagctgtggacccagtggtcccactgggagctgggcctaggccaggatgattcttctttcttctttcttccttctttcttctctcctcctcctcttcttcttcttcctcttttcttcttcttcctt

SEQ ID NO: 339122 - DNA, 514 bp, Homo sapiens
cgtcatcttagcacacaaaattttgaaaacattttaattcatgcaagtcaagttcattcttaaatattacatttcattcctctggaaaactgtaacagccaatggagaaacagtaaacatgtctcttctctacattttcactactatggaaatgagaaagaaaagtgaagtaggactgcacttacccatttccattctcaaacccttctttacaatagtgctagatgaaaagattgttacaggccaggtgcagtggttcacacttgtaatcccagcactttgggaggccgaggcaggtggatcactttaagaccagcctggccaacacggtgaaaccccgtctctactaaaaatacaaaattagctgggcatggtggcgggcacctgtagtcccagctactcaggaggctgaggcaggagaatagcttgaacccaggagacagaggctgcagtgagctgagatggcaccactgcactccagcctgggcaacaaagtgaaactccatctcaaaaa

SEQ ID NO: 339123 - DNA, 527 bp, Homo sapiens
attacaggcgtgtaccaccacgcccggctaattttttgtatttttagtagaaatagggtttcaccatgttggccaggctggtctcgaaatcctgacctcaaataatccacccgtctcggcctcccaaagtgttagaggattacaggcttgagccaccaccgctcgctaacatattttctctattattcttagttgaaaacaacagagaagtccaagtgccactccatctctgaagcacagatagcctttctgctgaaggcaatggtctgggagcaccagtctcgaatcagatcaatttcatacccacctagaagctacgtaagtgaagacccataacccttaatttactttttttccatttataaaactaaagactacaacaggaaagaaaaataaaataaaacagatgtaattagagaaggagagtaggtagaaagaacgcaaaagtgaagccctcctggccctgagcttcacttaaggaaacgaacatgacaccccagtgagcgatgagcaatcaggtccggcta

SEQ ID NO: 339124 - DNA, 310 bp, Homo sapiens
ggagttagaaagagggcagggggcaaggaaggaagacacgaagggcagagcagtggagaaggctggggagttgctgagtccagttgaacaaggacccactaggacagtgattcttgttttttttcgaaggcacaaaacccttcggagaaactgatgaaaaatggggatccttccccaaggaaaaaaaaatgcatgcaaacacacataagcatatatttccaaggacttcaaagatcccagcttaagaatcctttactttggccgggcgcggtggctcacgcctgtaatcccagcactttgggaggccgag

SEQ ID NO: 339125 - DNA, 371 bp, Homo sapiens
tcagttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtgagccaggcacctgccctc

SEQ ID NO: 339126 - DNA, 1228 bp, Homo sapiens
tcagttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggtggctgcagcaggaggaggaagagcggcggcaccaagagctgctgcagaagaagaaggaagaggagcaggagcggctgcggaaggcggccgaggctaagcggctggcagagcagcgggagcaggagcggcggagcaggagcggcgcgagcaggagcggcgcgacaggagcggcgggagcaggagcggcgcgagcaggagcgacagctggcagagcaggagcgtcggcgggagcaggagcggctccaggccgagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacac

SEQ ID NO: 339127 - DNA, 364 bp, Homo sapiens
tggaaagcaacgcagggcaaggagagaggtggccaggattaacctaataatcagctttataaaagtcacacttatgggtcccatggtgtgctggaaaggacttaactctcccaggtctcagcgagcagcctcagtgtgtaaaatgaagtttgctacatgatcctcaaggccttcttcatgtctgatttcctatgactaaattccgataattaatatattctgctgaagagctcagactgaacatgatcattgtcacggttcagtttctacctcagtttccttggaactttggaaaggacctgtcatgtgtagagtgagcacaaactatgaacagaaaaagagccgggaagccccagccttggta

SEQ ID NO: 339128 - DNA, 94 bp, Homo sapiens
ctgacaactgtccttagggcactgcacttgatatcatgtaatgacaaggggacatataaataatctggttgaaatgacaggtcgaggttagtaa

SEQ ID NO: 339129 - DNA, 685 bp, Homo sapiens
tctctcactggaggacctttactcattgcctttcacttcaccattagtaacatgtcaagagctgcttggatcataaataacacgaaccgttcatggcacggagagcagagaacaggcagatagtactgacacacgtaggatttcgtaatatgtgtgccaacccagcacacacactgcagaacctgcttctcccctgtccacttgcccagaccctggagagactgggtacacagatgtcaggattctcttttgtaaaactgacgtttgtctggtgggggtcagagccttccagcggtagccacccacttgtgttacagatgtcacctcatgcctctcctgcaccttcccctaacaagtctcagatgctgagacttggagatgggaagagtatttttgcaccatctctgcacagtgtggctcagggacctcacagcctaaaggtcaccctgtgcaaggcaaagtgctcctgcttgaataaccacagtctttgtccagtgtctatctcttccctctcagtttatttgcttctctgcctctacccctaagaatctgtataaataatgagcttctcaggtcattcaagggcaactcattaactcccttaggaaaagccagcaatgtcttttcttccaaagtggtggcttaatggccacaagcagataatgctttataaaaaggtaataat

SEQ ID NO: 339130 - DNA, 284 bp, Homo sapiens
ggggaagttcattggggcagagacttagtttgagggcttgcagagagaggtggggacagtaggagaagggtgatggggatggagagcaggaggtgtgtggggcatttaaaggatagcgggagaagtgcgtgaaatggagggtgtttatgcaggaagtatggaagaaggtgggatcagcaagagagggaattttgaggtaggacggagggtgaggggttcttggcaagtgttggaggacgttaggggcaggagctgggggagagggacaggtgtggggtggcgtg

SEQ ID NO: 339131 - DNA, 280 bp, Homo sapiens
ccaaatgtggctgctgtggaagagagactctcatggtcaagcttagcagcagggagaaatagcagaaggccctttcctctttccaaatgagagaggatggatagtcatttgaactggaatcttggtggtgagagggtgagaagtggttcggtctgtgatctctgttagagccagagccttcagaaattactgctgcactgggtgtagagtgtggtagaatgatactagtcaagagtgaatcctaagtgcttagcctgaaaagttgggtgaatactattta

SEQ ID NO: 339132 - DNA, 244 bp, Homo sapiens
actaacacagttgcttaaagaggtaatgtggaaaaatggggaaaaaattaaaacactgacttaaattctggttccttttctaccacttttggttgagtaacttatacaagaaatttaacctttgtgtgccggggctttcatcagtggtcctagtagttagcctcctgcactggtcaggttaggctaaactctgttgcaataacaacttaccctctaaatctcaggtccctaggccagagtttgg

SEQ ID NO: 339133 - DNA, 163 bp, Homo sapiens
aggtgtgagctaccgtgccctgctgaaacagacagtctttgatttgatctctgcaggattaggaagaaaagtcttttcagaaagaagcaaagatcagaggtggaaagtctgcagatatgcaggaaatggtctgtagttgagtgtagctacaggatagactttg

SEQ ID NO: 339134 - DNA, 376 bp, Homo sapiens
catagtacactacttgactcaccagtgacttttaaaaatggaattccatctactactcaaaacctctcaggggcatttcaccacacttagaataaaatccacacttaccaggactaaggaacttcaatgatgtggctccactcctgaaatctcccctctcagattatgctctgggaagtttcatttgctgttccatatgcatgggacactcttacctccagaccatggtactcaggtgtcagctgaaagttcaccttttctgtgaagctttccctgaccagtcagtataaatttgtaccagctttctctcagttctgtcactactgcatcatttcattttattcatattgcatcactgactgaaaatatttgatat

SEQ ID NO: 339135 - DNA, 174 bp, Homo sapiens
ttcaggcttttgagagaaataatcttattggatggtttgggtcagatgttctcttggggtccaatcagctatggcctaagagtggtgtcatggagaacaaatatggcgccaaatcttaccctgtggacagaatggatacctcaggggaggcccgttcctctggcgctgtagaaa

SEQ ID NO: 339136 - DNA, 319 bp, Homo sapiens
agcatattaaaagtgttatataccattagtaagtggaatttatcccaggaatgtaagggtgggtcaatttaagaataatagtcaatgtaatacaccacattaaaatgaaaatggaaataccatgtgatcgtctcaatttttgcagaaaaggcatttgacagaattcagtacccttttatgattaaaaaaatgagcacagcaaaactagaaataggaaggacaagatgatgaaggacatttgtaacacaaccacaggtaacatcacactcactggtgagaaactgaaagcttttgtcctaagatcaggaagaagacacag

SEQ ID NO: 339137 - DNA, 368 bp, Homo sapiens
tactgtgtgtgagagagatcgaagagaatggaaagagatttaagaaaataggccaaatgtcaattcaaaagggacaaagtgttctaaaaactacataaattgacattcacaactgaaaattcttcagaaataattgttaaatatatgatttgtgacatttaggggaataaagcactgactaccaggagccagtacagattctggaaaaataagccaggcccctataacttcagctcattttaaaaatagggtttccagcaaaggaatgctctgatgtattttgcaatatattttgacttcagacaagatacgggcgaagtgtctttcaagatttcttgtggagatatatgttgtcagctaaataactc

SEQ ID NO: 339138 - DNA, 517 bp, Homo sapiens
ctttatgacctgaaaccatgaattaaaattgtatgtcttcttgatggattgacagttttatcaagacaatccctttctgtctctggtaattttcattggtctgaagtctactttatgtggtattaatgtagccactctagctactaatgtagcctctctagatttcttttgattggtgtttgtatgacacatctttactttcatactacctctatcaataaaattaaagttagtttctcatagacactgtattgatgagtcattttttttaaatttactctaccaatctctgtcctttaactggtatatttagaacatttacacttaataaaattattggtaatttgttaaggctcaactctgccattttaatatttgttttctgtttgttttcctttattgttgtttatctgcttcccctttctgctttcctgtgagtgatttgaacatttttagtgttccattttgctctacctatagtgtttctgagaatatctttttgtatatttttagtggt

SEQ ID NO: 339139 - DNA, 278 bp, Homo sapiens
tgtatctcaaatatattggctctcattcagttcctaacttcaggaactacacaatgttttactcctttaccttgctgattattccatttttgaggactcagtttaaatgcaatttccacagacactttcttgaacccttcacactaagtaattactcatcgaggcaatactaatgctctaacaaagaaaatgtctttgacaatacctttccctcaaatacttgttgggctccttggtaggcttttaatctacttactaatcagttccatgttctagtg

SEQ ID NO: 339140 - DNA, 508 bp, Homo sapiens
tatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatag

SEQ ID NO: 339141 - DNA, 683 bp, Homo sapiens
ttggggggaagaaataaatagatgttttcattaggattttgcagagggccacctgattatttgtatgtctttgtatcatttacggggaaattatatgttgcctatgacttggaagttttcaaggtgagttgctattgtcatttttaaggttgtgatttgttttccttgtcttgccagcctcctgtgattaggtaggttctgcctttggaatgacaaggttcttcctgcatgtttttctcatgtgcgcaatggtttcgtctcccctccacccttagaatttgcaggtctaggtcttccgcctgtgcttcccttcatgccatagcccccatgtgacaggtgctagagactgtgtgacagccataactaaatgccacttgggacttctgcacagcatgtcagatgcacagctcattgtttgcctccaggcctacagttaaccaggaaagatttttgttgtctaattattttataatttcctgagagcagaaaaagtggattttaattaagtaccagatgtcttttaaggtcctaccttctaaaagttttccaaaaagtttttaaaacaatttttctagatttggaatttcattgtggacttgttaatatctctgaagtgtctcatgtcttgagaatcttgcaggactttattctctgcggttcagtccaagtttgcagattttaaa

SEQ ID NO: 339142 - DNA, 136 bp, Homo sapiens
cctggatagaaatggacctcagaatacagaatggagtccttgagtgtcagttggtgaggaccatggagtcctgccagctcaacctgtcatttacagactaagaaagggaagtacacacctggcttgtggccagtct

SEQ ID NO: 339143 - DNA, 328 bp, Homo sapiens
tgatggagttttgctcttgttgcccaggctggagtgcaatggtgggatctcggctcaccacaacctccacctcccaggttcaagcgattctcctgcttcagcctcccgagtacctgggactacaggcatgcaccaccatgcccggctacttttgtatttttagtagagacaaggtttctccatgttggtcaggctagtctcaaactccataccccaggtgatccacccaccttggcctcccgaagtgctgggattacaggcataagccaccgcgtccggctgaaaaaaaaatattcttaatccataacacttgatcagaaattatttt

SEQ ID NO: 339144 - DNA, 937 bp, Homo sapiens
tatcctacaaagctaggtctgatgtccctacatttactcttggccttcatctgtaccacactatctcagtcactccacaccagccacagtgaactgtccgtcccttggccatgccagcctgattcttccttgcatcagggcctttgcactgactgttctcttgccctagatgttcttttcaaagttattccctgggctcttcacatccttgagatttttactcagtcacctcagagatgccttcccaaatcaccctatctaaaattctaaaacctcaccccacttctgtgactatcctttctccttccctgctttatttctcttcatgccactcatcactttctgatacagtgtgtattttatttattcatgtaattggcccatctttctcctctagactttcatgtcagtgagggtagatttttgtctttgttcacttctgtatccccagggtttaaaatagtgcctatcacacagtaggagcataataaatacttgccaaatgaaggcataatccataggagtaatggatgaggcagactaggatgttgggaaatggtctacagagactggcaggaggcttttgccattgtcctggtgctccaactggtgtaggggtggggaggaattgagagagttggcagaggtggaatccatttgccttgataattggtttgatatggaaggtagagagaagtagtcatgggactgagtaagtgccatggatgacaggaagatgcttctgttatcaggtaagctgaaagagagagggcgcagtatgtcaataaccagcaagggttctggttattgactgctacacaacaaaccactctaaaactgagtggcttaggagagcaactatgttttaatctcccacagttctttgggtttacccaaagcggatgtgatcagctgagatgtgagtgatgcatcttgc

SEQ ID NO: 339145 - DNA, 325 bp, Homo sapiens
ctcccaggttcaagcgatcttcctacctcagcctcccaagtagctgggactataggtgcgcaccaccatacctggctaattttttgtatttttggtagagacagggttttgctgtgttgcccaggctggtctcgaactcctgagctcaggtgatccacccacttcggcctcccaaagtgctggaattacaggtgtgaacaaccacgcctggcctcaatatcctttttctaccccaggacctcttgggatcccacatgacatttagacattaatctccttaggctccatggttcaaattttaagtgagttttgcagtgccttttca

SEQ ID NO: 339146 - DNA, 338 bp, Homo sapiens
aggcgtggtggctcatgcctatatcgccaacactttgggaagccaaggtgcgaggatcacttgagaccaggcatttgagaccagcctgggcaacataggagaccctatccctacaaaaatttttttttaattagctaggcatggtggtgcgcacatatggtcccagctactcaggaggctgagatgtaaggattgcttgaacccaagaagttgaggttggactgagccatgattgtgccactgcgctccagcctgggagacaaagtgagatcctgtctaaaaaaaataaaaaattttaaaaaaggaacatctactatgtgctaattgtgcgtgttggg

SEQ ID NO: 339147 - DNA, 239 bp, Homo sapiens
aatatagtatgtgtattataggataatagggtaattaggatggaagatggaattgttttctaattctatttaagtacagaaatataattactattgatattttgcttttacaattggagataatctcgtgatgacatatggaaaccttgggaattactattttgtaaataagcttaaagcgtactagacataaatgttcagtctggtatttagagaataatggaatagttaaatatggg

SEQ ID NO: 339148 - DNA, 529 bp, Homo sapiens
gcataaaaacaacattaatctccttgtacaactgcagcagagctcttagtgtacaggtacatggcctgtaatattttgaaaggaatttttgtttttgtccagtaggtcccaacagcgggcttaaaatattcagcaaatcatggtgtaaacagatgtgctttcctccaggctttgttgttccatttatgtagcaaaggcagagtagatttatcgtcatttttaagggtttaggatttttggaatggtatatgagcattggcttcaacctcaagttccagcttcatcagcctttaccaagagagtcagtctttcctttgaagctttgaagccagatattgacctctctctagctgtgaaatttctagatggaatcttcttccaatttaaggctgttttgtctctattgaaaatctgttgtttagtgtaaccaccttcatcatttatctcactcagctggatcttctggcttttcttgctgagcttttctgtcagcatttgctgcttccctttgcagttttattgttttctc

SEQ ID NO: 339149 - DNA, 250 bp, Homo sapiens
ctcctatcaaatcgcctttccctcccccggcgcgagaatcgcaccttgctccttgtggatcgggcgccgccgacggaaccacctgctgtctatagagggcacctaggacgcagcgtccaattcccctcactggcttcaaaagacaaatctccgtattgttgtaccaggaggcacgagaagcctcaccactgtaggtttttcagcagaggtcactggaggtctggttaaacccgtacagcactgaggggga

SEQ ID NO: 339150 - DNA, 323 bp, Homo sapiens
tcggctcggtacccaggtagactaacttcagtgacagcccaggatgtttgctccctgggttcagccggcaatctccaaagcaaggaactcccccttttccccaaatgtctcaatagttattccttcctttgaagttggaagaaagaataaaattactttcatctgcctagaaaatagagtagagaggaattctacttggaatcagaatgagaatcagaagaggaatcgggcagctcaaatctgttaggtctacctgggcctacgttttcacacttctagtaagcctctacctgggttaggttaccggggttaggtctaccggg

SEQ ID NO: 339151 - DNA, 352 bp, Homo sapiens
taaatcatggactaaacgggcttccaggagctacaggctgcagcagcagcttctcctctacgtccttcactgcctcaaactgttgttgactttgaaagcttctttcagtctagttttatcaacagagctagtatttcatgaggttctactacataccaggttccagaaagctaaatgccttttgtttgttattattctctaaatacaaatcacaactcctcattactcacacaacaaaatttagctgcgggagattgagtgactttcccagggtcacatagctactaagagcagagtcgtgtttagattcatgtgggaatattgaacacagaaatgaaccagtggaaacatc

SEQ ID NO: 339152 - DNA, 157 bp, Homo sapiens
actttacattcattgaaggagtcattgttggaactaagagagcaaggaaaccgtcgtctgtgaacaggagttaattacattgattaactctaaccaagttgtttttttcaccaggaccattttaagagaccacaatacccaggcagcagcttcacag

SEQ ID NO: 339153 - DNA, 263 bp, Homo sapiens
cagctatggcattggaggctgaaattgttaagtgtagaagttcagattgactctagagtttcaggatacttacatctgattcggctagtacattttttgtcttggtatagtaatggattcctggcgttttctgttctcccatcttccctgatatccttttctttttcgtcttcatcgtctttgttttcatcgtctttgtcctcttcgtcatctttgtttcttcatcctccttgtcctcctcctctttgtcctcttcctcctcc

SEQ ID NO: 339154 - DNA, 410 bp, Homo sapiens
acacttcaatagtatacttgtatctatttttggaatcgtgagtatgtaacttccaaagtaatatgaggaaacaaagatcagaactgtgtaatctaatgtgtagggaaagattagtgactgctgtgtttcttgttttttaaagttctctatactgttcagaaagaatctgaaattgattagtatcttagatggaatcaaataggcatgacaaatttccagggaacagtttattgtgagtttgtggtagtttaaacagtgatattagtatagtaatacacagagcacaggaacagagggcacagggtgcacctctctggtaatacatggagagaagggtgttgtagggtacatattttattttattttatttatgtatgtatgtatttatttatttatttttgagatggagt

SEQ ID NO: 339155 - DNA, 126 bp, Homo sapiens
atgaatctctatcagaacagccaacagagaaaatgtattcagatgcaggaaggctagaaggcagcctgtagcagcaactacacccatttcactctgtattgggtcaggcaagacttcattaacaac

SEQ ID NO: 339156 - DNA, 431 bp, Homo sapiens
ggggtgggggccatccaatgttaattctctttactgtgacaatattgctggtacagtaagataaaactatcttaggatgctaaacttactctctggatgtgctttgtacactgcttgtactatgtgtgactcactttattgactttattaactaggactgtaagatgctttagttttgtttgtgtttttgtacaaaaagagtctcattctgtcacccaggctgtagagcagtggcgtgatcatagttcactgcaacctcaaactcctgggctcaagggatcttcccaatgtagcctcccaagtggctaggactacaggtgcacaactctatacccttcgctgttgaacgtatagaaagtacccagactacaaatgagtttcgtctgcagatatttcaaataatgaagactgtagaaatctaccccatattt

SEQ ID NO: 339157 - DNA, 430 bp, Homo sapiens
ttgaaactgggcacagaaattcaatggaagccaattacactgctaaaacaatagctatcctgtacctttacagaatcaaacaaaatagcaggacaaagagaacatgagagataaaagatactgctagtttctaagaggaatgcaagtctaagtggacactgaccccagcatcttggatgtgtgttctgttctttaagaaatgtagttattcattctctttagaaaaacaaagtgtaggaatttataaaccatgtcaatcaaactagagactgggtttattcagttccactatttctcagtacattttaaaaacttacatacataaatatttgggttgatcagcatttgtgccaacttaactaccacttttgtagaaactggcagtcaatttctgtgcccatttcaggtaccgactcgattctatctatct

SEQ ID NO: 339158 - DNA, 312 bp, Homo sapiens
ctatcagccaaactttcctctattcccatccattatacttattctatctcttttccctgaagaatctgatgccttgtggctttccctgccagacttcaaaacactaacgagtacattctagtcctcaagtaatagatttgctaaatcatttgctaaacaatttaggaccattctttattaatggattccttcaatttctaaaattgacagtttcctacagtatctttatcaccattgacctaataagtgatttttatcctaagtcacacatagaaatggctactccttacatccttacatgaaaacattttt

SEQ ID NO: 339159 - DNA, 292 bp, Homo sapiens
aagctattatgagcatgtacagagagaggtaggtttggaaatggtgacacaccacacttaagtgacttcttctgggaagtgggatttaacggagaaagatggagggtgttttcatgttttattttaccctcctaaattgtttgtacatgtgttacttttgctcaggcaatccttccaactcagcctcccaattagctggaaccacaggcgcatacgacaatgcccggctaattttttgtatttttactagagacggggctttgccatgttgcccacgctggtcttgaactcc

SEQ ID NO: 339160 - DNA, 113 bp, Homo sapiens
ctcatgtaaaccagatttgcaaataaacactgagtattcaccagcccataaaaatggtctggtcagctcacactgcagaaaccaaacattagattctggtgagtgataaaata

SEQ ID NO: 339161 - DNA, 1011 bp, Homo sapiens
cttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgc

SEQ ID NO: 339162 - DNA, 507 bp, Homo sapiens
ggggagaaaaggtactggtgctgagacattttcaacagggcagaacactgtgacattggtgttctagaaagatccctggtggcagtgtacaagacgcactggaggggattagaactgcaaggcagacagcgctgggcagaagacacagtaacccagacaggaagttgtggtgcctgaacttgacagtggccagtgggaaggggaggagacacaggaaagacggtagttaaatcttcctaagagtgcgcagaggtagagatgagggtaagggaggagactggctgatgcccaggtggaaagctgtgttttcaacaagacggcgagccctggaggaaaagcagaacggatgggtatgagagcctgaggggcactgaggttagatagaggcagagggatggagcgatatgggagtctgcagtgtagtgaaggccttggaggaagtgacacaattctgaagtagtgattggtctcatgtgggaatatgattgctatggtctgaatgtgttc

SEQ ID NO: 339163 - DNA, 1528 bp, Homo sapiens
agcggaatttccgtttccggcggtgtccaagcggacctaaggagtcgcagttgtgaacaggttagagttacttgttattggtaaatagccactatggagactaaggaccagaagaaacacagaaagaaaaacagtggacccaaagctgcaaagaaaaagaagtggcatctgcaggatctccagctaggagacgaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaatagcggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtttgtgattattaacaggatcatggtcattatcagggatatagtaagatgtgattgaacttgatgatgataataataattagtaataaatgttgtcatattaataatacaactggaatgtgcacaatgaaatgtgttccaaaatctaaaagcagatcacaggatggagaaaacctttaatgagcacagctaataagagctcattaacattcatacatatatatgtacaaatatatcatagtaagtaccatttcttcttggatccttcctggcactgtgctaactgctttctacaaatttagcttacataaacccttgatacacccttgaggtgagtaggtattatctatagtttacataagatgaaatagagcctcccagcagttaagtaacttgtgtgaagatgggacccttgttcctgatggttctagaaccttcatccttaatgataatgctaaagtaagtacatgaattgcctgaagaagtggtcagagtttatcaatagaaaatttagatagtactcagcgtgtggaaaatgtacatttatggaaatgataatgttcactatctctgatattctatgatcttttacattagcaaaaaaaaaaaaaaaaaaaaaaaaaggccagacacagtggctcatgcctgtaatcccagcactttgggagaccgaagtgggtgaatcacctgaggtcgggagttcgagaccagcctgaccaacatgcagaaaccccgtctctactaaaaatacaaaattagacgggtgaggtggtgcatgcctgtaatcccagttacttaggaggctgaggcaggagaattgcttcaacccaggagatggaggttgcggtgaggcgagatcgtgccattgcactctagcctgggcaacaagagtgaaattctgtctc

SEQ ID NO: 339164 - DNA, 871 bp, Homo sapiens
agcggaatttccgtttccggcggtgtccaagcggacctaaggagtcgcagttgtgaacaggttagagttacttgttattggtaaatagccactatggagactaaggaccagaagaaacacagaaagaaaaacagtggacccaaagctgcaaagaaaaagaagtggcatctgcaggatctccagctaggagacgaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaatagcggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggtgtgacattaacatgatgattgatctggctaaagtagcagatctggtactgatgcttatagatgccagctttgggtttgaaatggaaatgtttgagtttctaaacatctgtcaagcacatggctttcctaaaattctgggagttctcacccacctcgactccttcaagcataacaagcaactgaagaagacaaagaagtgattaaaacacaggttctggacagaagtttaccacggtgccaaactgttctacctttctggaatggtgcatggagaatatcaaaaccaagaaatccacaatctgggccattttattacagttatgaagtttaggcctctcatggcaaacttttcacccttatatcctggcagacaggt

SEQ ID NO: 339165 - DNA, 418 bp, Homo sapiens
agaatgtgcccagttattgtaggagacagagacggtcacacaccggcctatctgcagggcagagtttgggcattttcagctgctctgtgtgtattgaagagttaaaaaaatgaaaagacggccaaatagttatcaccaaaaggaggccgtcagtcattgctcatgaacacagtctaaacacagttcaggcatatttagttcgcgtgtttctccccagcacacagcaaatcagaagcaggcaggagaagggaagtagtaatgcacattggaagcttgagtatcaggaggagctctccctctcatgcagatattcccagcgtgctccctgtatcggcagcctcagcatcacctgggaccttattagaactccaaattctcaggcccttcaccctagaccaacctaccaaactagaatgcc

SEQ ID NO: 339166 - DNA, 1123 bp, Homo sapiens
aggaaagaaagaaaggaaagaggaaggaaggaaggagaggggaaggaaggaaggaggggaaggaaggagagagagaggaaggaaggaaggagggaagggaaggaaaggggaggggaggggaggagagggagaaaagaaaggaaaaagaacaagtggatatcaggggacagaaaccattcgcagcccatccctcggcagatgcagagggagtcagcctggaacccccacccctgctggctgtgccccaccgctgtctccacaccccagcccttcctccagacacccagccgtccactgcagcaggagcacaggtgccccaaggggaccactgttggaaaccaggcagccctccactcacccacacagtgtgtctctgcaccccctctttgacatgggagccggggcgctcttggaaataagggtttacctgaggggtctgaagacttgggcagtggggggctgtgaagccttggggagggaatcagcttgtccaagagtctggggcagcgagtggtcgggggctacccggtctgaccccatcaaagtaaccttcctgggggatatttccattgcagggtcacaaaaaggcaagggctaaggttcgagagaggggtctctctggggtcccagccaccctgctgtgggggcccttcccaagcaggacactccaggcaaaggggatggctttcccttgctcccaggacccataggtgaggtcctggctgaaatgcagactgtccccagatgcccctggggacttgtagggatttgggggattcagtgttgcaggagctggaacccttgcttgctggacgggtttgagctgtgctgtcaggcccaaagctcctgggtctccaggatggtgcatgagggctcacaccagctgctccctgccacccttcccccacctcccaccccttctcctggagccccagtcctctggtctccaagctcagcttcaaatgcttccaccacttctgtctcttctacctcgagtggtttgtcaacctccaaatcacacggagttcaagaatatctcaaatatcgaccaggtgcggtgtctcacacctgtaatgccagcactttgggaggccgaggcgggtagatcacctgaggtcaggag

SEQ ID NO: 339167 - DNA, 482 bp, Homo sapiens
cctgaaacagcaggggtggcggaagagcagctgagggagacgtgggctctcccagccccattgtgatcactgcatcacggagttgactggaattcaagaaatggtgttttttcctgtctggatatttggctgtgaacgtaagtactttcctgaggacgcagtggagtctatctcggctgcggctgtgttctcaccctgggcagtggcctttgggttaagaatgccagggacgtgtctttaatccccagcctgtatctggcacggaggatgtgctgagtaactatcagaaggaagcaccatcccccgccctccccttagagggcctctgttacgtggtcacctcacagactgtgcttcagcccagccctggggtgcttgggagaataggcggaacagctacgtggtcagcggccatcccttgcaagtaacagtccccctcctaatgaccctcacgctgcatggcccgttacagtggttcagta

SEQ ID NO: 339168 - DNA, 541 bp, Homo sapiens
atcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatct

SEQ ID NO: 339169 - DNA, 407 bp, Homo sapiens
tcttacaatgcgcatgtgtgtactggggaggaggtcttgacggaacaatgaaacattccacttccaagaaaatgtggaaaatgattcataaaataacaacttattgctagcaacttcctgtcagttacaaatgaccaaagtacaacctaaaataaaatgaatcagttagcatgatgttcagaaacctcattgatgttatataaattcagatacatgggaaacagctccaagtgggacagaaggcagcgtgtgtgtgtgtgtgtgtgtgtgtgtgtgtacatatatatatattttttttttcagataaggtcttgctctgttgccccagctagaatgcagtgatgccctcatggttcagcacagcctcaacctcctggactcaggaggcatgggactcacctcccatg

SEQ ID NO: 339170 - DNA, 471 bp, Homo sapiens
cccgaggccggggtttccctgtgccccagattgggccccctcccatcccccctgggcccacacaagtgaaccctttttcccaaaaaaaaaaaaaaaaaaaaaaaaaaaaaaaaaaaaaaaaaaaaaaaaaaatcacataactgtatggttgaatatccattgtgttctttacaaagtatgtcattctttctgtaacatccgtggtggaatataaccttagtattacacaaccaccatcagcagcagcagcatttgagagcttagcagaaatgtagaatgtcgggctccatctcggacctactgaatcaaaatctgcattttagcaagatctccaggtgatatacaggatcattaaagttagagaagtcctggtatacaggataagtcttaccaattgctgtatagacctatgttcacttcatggataacatttgctctagaaaagaaaaattaaccagtagagagggccag

SEQ ID NO: 339171 - DNA, 103 bp, Homo sapiens
tgcctcagccccccaaagtgctgggattacaggtatgagctcccgtgcctagcctagattagtgtttaattgactgaatactgtagctttgctacgtggacac

SEQ ID NO: 339172 - DNA, 247 bp, Homo sapiens
ccatctgcctccactctgcttaggaccgcagactgatacctcaggagtctagacccacggaatctgtaagcaagctgatcaggactttggaacttactatatataccctacgtgttttttgttttccttagaaattcatcaatggtcttgtgtttgttcttttttttccttaactttattgagaagtaatttacatgcattactatgtctgtctaaaatgcacacctcgttaagttgtgactgttgt

SEQ ID NO: 339173 - DNA, 279 bp, Homo sapiens
gcgtgtgagtgtcctgatcatggacacagagcgtggggccccttggagggctggaacccaggtgggggatgcctgggtggtgggacagagtggggctggaggagagggtctgaggaatgttccggccacagacaccccaagcccacgggaggtcaggagttggtcacaaggaaggtgaggtggggaacagagctggggcccagggtcctgatttggggtgagaggtgacgccatccccgagtcagaaagacggccaggggaggggaggaggtggggaaa

SEQ ID NO: 339174 - DNA, 384 bp, Homo sapiens
tgaagaacaattctttaaataagtcttttgagtacattacaaagcaaaagagatcttgattacaggaaaggtacttaggcattaagagaaattttgtgaaaaaaaatctaggagtgttgtaagtaaaaatctggaagatataacttgtcttgtagttcacattataatttctgttaccatagttaactatttagctgtcatctaggtattattaatatatagaatgcatgatacgtaacaataaatagttatgtcatagggagactctatcataaacaattctttttcgtgataaaagtggtaggaatagcattttaaatgaataactttagctaacatgtagcactgcgtatcagatactcttgtaatcacttcatgtgaatt

SEQ ID NO: 339175 - DNA, 274 bp, Homo sapiens
aaaaattagccaggtgtggtggtacatgcctgtagtcccagctacttgggaggctgaggcacgagaattgcttgaacctgggaggcggaggttgcagtgagctgggagcacgccactgcactccagcatgggtgatagagcaagactcagtctcaaaaaaaaagaacttgcagtattttgtaaaaatggactatgcttttcatactgtttttcaccttgcttttttaacttactatcatttggacatctgtcaggatgttctttttaacgcgac

SEQ ID NO: 339176 - DNA, 525 bp, Homo sapiens
tgaaacagtaagtttcttttcaaaggggtggggtttttactttttttgtgtgatgaggcttgaggacaagccctccacaacaacagactgcctgagctgttgaacctggacaggtggcagcttccagagacttggatcatcttctgtaaagaggcactagaacagcagatgccacctgcaagtcacatcccactctgccattctgggctctgatctggcttaccagacttgatcaattcccttccagacattttactgcacaataccaagtaccatagaattaatcatgcaaggcaccatttgcaaagaggtaacagcattccagtgtgagatgccagggatgtttccttcctctcatcccagttctgtctgccgaagctcgtgagcagggcaccctaacatcccacttatgggtgatggcaccttcgactgtgatctttgcttatatacaatagggaggagcaaggaaaccccatcttggtataagggaaagtgaggaatataaataaggagctgggggaggag

SEQ ID NO: 339177 - DNA, 198 bp, Homo sapiens
ccactgtgtgttggggaggagacttagggcttagaccttgccccagaagagctaaggctcagatggggcacaggagtactctcctccttagcaaatgaaatgagatgtacctagactatgtgctaatagtgggacccaaaaacacattccaggagatcggaggaggaagctatcaccctgggcgcggcagggtctaat

SEQ ID NO: 339178 - DNA, 367 bp, Homo sapiens
agatcagctgataaataactagaaaaacctttgaaactatcagtggtccaatatttacattttgtttttagacatacaaataatatgtaagtacattctctaaaaattcaaacaatctaaaagaataaaataaagagtcctcttcaactccttttctccttatttctctttcttcagattgttaacagtttggtgtatagcctttcagatatttttgtaaaaagaatttttttttttttgagatagagtttcactcttgttgcgcacgctaaagtgcggtggtgtgatctgggctcactgcaacctctgcctcctgggttcaagtgattctcctgcctcagcctcctgagtagctgggattacaggc

SEQ ID NO: 339179 - DNA, 368 bp, Homo sapiens
agagtgtgtaacagtgatgactttgtgtggagtgcaaattgtatgcatctcacgatatttacattgaatcatgtaagtatcattgatatgtaagtatgatatgatacacagaatgatgtaaagatctcttgagtgtggtttttgagttctttctatggaaatgtttatgaatttacattcctcagttggtttcctttgtgactaacaatttgttttcacaagataggtcaacaatttgcatttcagtctgttagtgaggttaactaatccatactgaccatggcctcaggggtatctggctacggctgtgtttgctggtgaaactaagggaagtaagttaaaaatcaaacaactctcttagaaagact

SEQ ID NO: 339180 - DNA, 118 bp, Homo sapiens
ttctgttgcttctgtcttcgttcttgcttctctcccccgtgtactgcgttgatttctgccattatttcttcacgcggctcttgcggttatcctctccccattctccctggctccccaa

SEQ ID NO: 339181 - DNA, 571 bp, Homo sapiens
aaccaagacttcttagctggactaagcaattgattaaactcgctacctgccgccttctgctcttgccaccctccatacccaaagaagaaagaaaggaaacaaaccttgtggactatccacaggataacacaagaagagagtaccacatctcaagaccacaagatggcttccagaggcaatggggaatcaagcttcattaccatattttacaggaaagatgttccataatgtcatctctagactaagcaaattcaacgtaaataaaagcataaattggtctctaacaacagctcgagggccttctggcaaggactaagtgaccacccttcaagacttcagtctgtcaatcaaatcttaggaaaacttgtccttaagaaagaggagaacttaaaaaggaaataaaagaaaacttgaaaagaaaaaagaagaaaggggaaaagtggagcttgaaggacattattgactcagtatacagatcagtaaaaagaaatgaaatagaaaaatataaaataaataaaataatttgaagagccaaaaatgaaataaagttcttgggctgattttaacccac

SEQ ID NO: 339182 - DNA, 548 bp, Homo sapiens
aaccaagacttcttagctggactaagcaattgattaaactcgctacctgccgccttctgctcttgccaccctccatacccaaagaagaaagaaaggaaacaaaccttgtggactatccacaggataacacaagaagagagtaccacatctcaagaccacaagatggcttccagaggcaatggggaatcaagcttcattaccatattttacaggaaagatgttccataatgtcatctctagactaagcaaattcaacgtaaataaaagctcgagggccttctggcaaggactaagtgaccacccttcaagacttcagtctgtcaatcaaatcttaggaaaacttgtccttaagaaagaggagaacttaaaaaggaaataaaagaaaacttgaaaagaaaaaagaagaaaggggaaaagtggagcttgaaggacattattgactcagtatacagatcagtaaaaagaaatgaaatagaaaaatataaaataaataaaataatttgaagagccaaaaatgaaataaagttcttgggctgattttaacccac

SEQ ID NO: 339183 - DNA, 184 bp, Homo sapiens
cattgcactccaggctggatgacaagagtgagactccatctcaaaaaaaaagaaaaagaaaatagactctaaaacattacaagtctttaagcaatcatgtcaaaactttagagtagttaagatattaaagtgaatatatctttcttcaaaactaccagtacacagccaacatacacaacaaaaa

SEQ ID NO: 339184 - DNA, 456 bp, Homo sapiens
aaagccatggtgtgttacttgagagagaggaagtttctggctgtctggctggaaaacaggacatcataggtggttttgggctttgcttggaagaaattaatggatgcctctatggatgcctctatatcccccagggtaaccgactttgctttatttttctagacattttcttagtcattcagtatgcttagggaacgtgcttacctggtcagaatcctctgtttcagctctaccccatctagcctccattgcatacttgtattttgagagatcgtaaagatttcttcccccaaggaaaaataagtttgggaaatgctgagtgaaattgatttctttaccacaggacttttaatatgccaatgtgcattatgaatttccaagaaaagaatagtatgtggtggttccttatttgacactggtacctttttttttaaattaatgaaagaccattagcat

SEQ ID NO: 339185 - DNA, 412 bp, Homo sapiens
caaatatctaattcaactactgaacattaaactggaaatataaagatggtggccgtattatttataatctgacacacagcccttctagtagagcttatacattcagcaagtgaaagaatatgagaatgtgagtattttgtgtgctcttcacgaaaataaagttgacattctgtagcatcctaaaacaagataagctaatgtaatttgaaaatggtaagtatgtttctaaaaatacatgttagaaagtttgaagtttgtgtttatagtcaatagtggctgacttcatctctagaattcttgaaatccaagttgttgatagttttaaaattttgtagcatgaggggggtctggtcatttggtccatattttattttattgtattttattctttttttttttttttttttttttt

SEQ ID NO: 339186 - DNA, 464 bp, Homo sapiens
cgaatgaagaaaggaagaaagttgcccttaggaaattatactggcagaagtgggagggaattagaaggaggctgttattatttatgtgattttcttttaccatttgtatattttacctggatttaaggaaaatgtcaattatgaaggccatatggcaacatctgtgacagagtgttaagatacaatatttgccaagataccactgagtactgagtatttatattactggttctcagcacttgacattttcctaaggatttatcaatggttatatgaaactctgtgtgctagctttctcacttaggaaaacataccaaatgtaagagagtgaaattgacattattataactctaatcttgggtgtgctatgctatattaaaagagataaaccttagcaaactggggtactttaaatatgattaataagtttaggtagaacatctcatgattcatcgctccatagt

SEQ ID NO: 339187 - DNA, 435 bp, Homo sapiens
taacaatgccaaacaaagagattatttttataggctacctctttctcagagaaaaaaagctttaaaatgttttaccacaaaagagtcaataatgaagttaataaaataaaaccagaaaaccagagccaaggcaatgagaaaaatgcgaatgtggtaacattgtagggaacaggtctgctgtaactgacctgcacatttgccctaggttttctggcaagaagggccagggacgtcatgagtcacagcaggagagaggaagcagaccaggttcctgatgggaatgtgtgtccccaacaggaattccaagtttgcttataatgcactttatatcaagtgctgtggatgatgtagtcagcagtgccttcaaaaccattttttgaacagtaaataaagacatattttatgcgtagagaatttggttaaaacaagatagta

SEQ ID NO: 339188 - DNA, 822 bp, Homo sapiens
gtggttgtggtgccccttgctgtctcagtcgcctgcctgaactctgattgtcacatggccacagcgctgcctcttgggcctggagcctcagtaagacccaccacaagggagggtggaaggtcccagggccccttcctaacgggaccagagctcaacacttgcccttctcaccattcagggtctcctcactgggactgtcactctggagcttcgcagagcaccccgcctttggaaggtgagagggaagaaaacgcagcactgtcctcccactccctaaaacagacacctacaaccctcagcctaggaagtaagtggctaagtgttgactcattctctcagctgtcaccactgactggcctcaatcactgaggaggaaagcaaaaaagttaagagggcttatggccctgtttggaggctgagaagcagaagctgagttttgtcttcagctaggctgcaagtggggattgaggttggaatgactcccctaggctgggcagggctgagctggctcactggcaggtgcgggccatgatgatattcaacaccttcaacttgatcttgggtttcatcgtggtggtggtcgaggtgatgaagacagccttggggcctgccccaactgcctcctcccaggtactggtcaatgaaggagaaggtgggaggataaggaggcaagaggaggtgggaagggaaaagggcaggggcaaacaggtgcggggtccctgcattctcagccctgtctacctgcagcatgctggcttgctggtgctggaactcagtgctgaggccttcaccctagggggagtgctggtctcagtgcacgcc

SEQ ID NO: 339189 - DNA, 705 bp, Homo sapiens
gtggttgtggtgccccttgctgtctcagtcgcctgcctgaactctgattgtcacatggccacagcgctgcctcttgggcctggagcctcagtaagacccaccacaagggagggtggaaggtcccagggccccttcctaacgggaccagagctcaacacttgcccttctcaccattcagggtctcctcactgggactgtcactctggagcttcgcagagcaccccgcctttggaaggtgagagggaagaaaacgcagcactgtcctcccactccctaaaacagacacctacaaccctcagcctaggaagtaagtggctaagtgttgactcattctctcagctgtcaccactgactggcctcaatcactgaggaggaaagcaaaaaagttaagagggcttatggccctgtttggaggctgagaagcagaagctgagttttgtcttcagctaggctgcaagtggggattgaggttggaatgactcccctaggctgggcagggctgagctggctcactggcaggtgcgggccatgatgatattcaacaccttcaacttgatcttgggtttcatcgtggtggtggtcgaggtgatgaagacagccttggggcctgccccaactgcctcctcccagcatgctggcttgctggtgctggaactcagtgctgaggccttcaccctagggggagtgctggtctcagtgcacgcc

SEQ ID NO: 339190 - DNA, 258 bp, Homo sapiens
ggtttgctgaaggaggaagatggaatgggagctaggacatttggaggggctagatagaagcagggacttggtatgggacaaagcagcatcttttctctcaggcctcatggactgtggagttttcatttcttgtaagcatttgccctgatgggagcatgcgctttagctctgacatcattttcaagaaagagaagggcaaactggcaccaaatagctacagaaaaagggaggggaatctgtcctttttttttttttttt

SEQ ID NO: 339191 - DNA, 294 bp, Homo sapiens
tctgggtttcctttgggaaacactcctccccagtcttcattcaagtggtttggatggggctaaatctacgccctatttgtagaggtagatgtatggtgcagacctaccttgcatttcatctccttggacagagtgtttgcttccaaggtggccacaggacccaagctggatcaatgagatacaaccttaggatttttgatggaactcttgggaaagagaggctcttcttcaatggttcctaagccttgaaatgtatgtctagggataccattctgtcacctcatgcccagagcc

SEQ ID NO: 339192 - DNA, 150 bp, Homo sapiens
agaaataatgttgattctgttccatatgtcagaccttggaaggtcaactgcatgactgtggctgagactttgtacttgggagtgtgcagttttaaatcctgaccactatcttaggcaagtcccttctcttttctgagtgcctgtctgctt

SEQ ID NO: 339193 - DNA, 801 bp, Homo sapiens
cccacctcaacctcccaagtagctgggaccacaggggcatgccaccacacccagctgattttttaatgttttgtagagatcaggtctcattatattgcccaagctgggggagttgattttaactttatgttagagtagtcagggaagacctcactgaggtgacatttaagcaaaaacctgaatgtggtgaagcaggtatctgggggaccttggaccacacaaagggaacagcaagtgcaaaggccctgaggtaggagcacgtagttgtggtgatgacggagagtagcaggaatttgtgtcatagaaatagtgggggctggccaggcacagcggctcatgcctgcaatcctagcactttgggaggccgaggtgggtggattacttgaggtcaggagtctgagaccagcctggccaacatggtgaaaccccatctctactaaaaattaaaaaaaaaaaaatggccaggcatggtggcgtgcatctgtaatcccagctattcaggaggctgagacatgagaatcacttgaacccgggaggcggaggttgcagtgagccgaaattgtgcctctgcactccaacctgggtgacaaagcaagactctgcctccaaaaaaaaaaaaatggaacatggaaacatggaatgggagaaaatatttgcaaatcatatatctgataaggggttcatatccagaatacataaagaactgttacaactcaacagcaataaaaacaactcaattaaaaatgggcaaaggacttgaataaacatttctccagagaaaactgtgaatggctaataatc

SEQ ID NO: 339194 - DNA, 736 bp, Homo sapiens
ataatgtcaaataaaaaaaaacaagatatgtctatgagaaactttttctatgaactttttatatgaacaaggctgaaaggaaatactctaaattagtggttgggttaaagtggtggactgtggtatgattttattccattacttttgtatttttaaaaaaattgctttaagctcaaatgtgcaatgagaaccaccatatcagctctgacaatttcttttgtctcttcttgcatggacttttaaacaaatcagtatattttaaacaagcatgtatgataaaagaacaggagagataattcttataatcttcctgagtagcacacaaggaggtgagaagaagaggcagaggttggggagtgtaattgcttcacagatccccatcctgtccctggtgaggcaggccaggtcatacacatactggtgggagggtcacagagtctttttcagtgcacaggagggagaatccagctccctcatactggctaaagactagttctttgccaccagctcccagtcctttttttttctgcatagcacctcattttgagttggagagcaacccttttcttactttttccaggggtggagaatgagattcaggacagactggccaaaagtatatcaactctctggactcagtgcctggatgagggatggcccaagacctaagcctgcccaatcagagtaactctccaggactcacgaacagatatttgctgtttgctgggcttgcact

SEQ ID NO: 339195 - DNA, 166 bp, Homo sapiens
gtggacaataagaagagatggggaaaatcattcagcagaggagaagtccctgcaagggcacagctggaagaggcagtcaggcaactgggcttcggggaactagaacctgaagtaccagacaggttgtgtgcgggcatttgaggggcagggtatagaaatagtaacc

SEQ ID NO: 339196 - DNA, 660 bp, Homo sapiens
tttgcctgaagtttactctaggtgcagaaataaagacaacttagtcaagtgaaggaaagggtaacagacttagaaatggctatctacactgatggaataagtatactaattagagcaggtaacaagtccccacgatgtataacatattcttctctaaaagctcacaacaatttatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccaaggtgggtggatcacgaggtcaggagttcgagaccagcctggccaacatggtgaaaccccgtctctactaaaaatacaaaaattgggtgtggtggtacatgcctgtaatcccagctgcttaggaggctgaggcaggagaatcacttgaacccaaaaggcagaggttgcagtgagccgagatc

SEQ ID NO: 339197 - DNA, 631 bp, Homo sapiens
caatgtcaggatttcagcgcccctgggaaaattaactcagctcctattctccagctctaatggaaatcctgggcagaaaccagcaaacttaagaagggtatgaaatgtaggtcccttaccagtcagccccaccctttttttttttttttggtaactgagataatttattgtatttttgatctgagttatcctagtctcagccatctcccaaaccaaaagattccatatggcatctttatgtttgtttatttccttataaagtgtgtttattttttgctgattagaaaagttgtgtacacgatagtccttacgatgaacctgaaaataacataaaaaggcaagaaaagtcactctaaatctctgtaccaaaaacctgtcactaccaagattggtatatttacttccaaaccttttgaattgtgcagatttcatatttgcttctgtatttaaaaatatataattttgataagattgtatatacatgtttatactcaggtttgacagactccctgtaaacagatctacccatctggtggatataccatagtttacagaactgcgcatgttatcagtttgtttcccatacttttttttactgttataaaataacaccgtaataagtttctctgtg

SEQ ID NO: 339198 - DNA, 318 bp, Homo sapiens
tgtcgtggccctatctagaattctcacacctcaggctgcggttggggagcagggaggcagcagccctgactgggaacctagaagactggactggatgacctgccaggggtctccccaaggcccggccaacttcccaggtgaccttgagcacagcctctttctggacctaggcttttccacctgtggagcagaggggcctgctggcctcaggcatccactgtggctctgagtctaaggtgagctcagccagggagcctgggggtcagggctcccacactcttggggcagataacctgaggcatccctgaccccaccccc

SEQ ID NO: 339199 - DNA, 95 bp, Homo sapiens
aaaactattagaagaaaacttttgagacctgctaaaagtcctccatgaaaaaccaaaattggcccggcgcagtggctcacacctgtaacccagaa

SEQ ID NO: 339200 - DNA, 329 bp, Homo sapiens
gtgagccgagatttcgccactgcactccaggctgggcaatagagggagactttgcctcagaaaaaaaaaaaaaaaaagaatcactaacctggttcagccttttcatttggcagatgagaaaactgaggactcagaaattaaataacttgcctaagatggtagagctctcttcaaacagaaccagaaattatggtgctacaaaaatacctgcttatcttagagccaaaacatttcaattttaaaaaatggcctcgtatggcagatacataagtcaggtatgccactcctgggatcatatcggatgggaggcaggattagattacagctcc

SEQ ID NO: 339201 - DNA, 458 bp, Homo sapiens
gtgagccgagatttcgccactgcactccaggctgggcaatagagggagactttgcctcagaaaaaaaaaaaaaaaaagaatcactaacctggttcagccttttcatttggcagatgagaaaactgaggactcagaaattaaataacttgcctaagatggtagagctctcttcaaacagaaccagaaattatggtgctacaaaaatacctgcttatcttagagccaaaacatttcaattttaaaaaatggcctcgtatggcagatacataagtcagctccagatcgactgcaagaacaaaccagcaatcctgagaggatccacagactctctgaaggaagcagactgctcctgcaggacccaggagacccccaaatactatcctgtgcatgtccacggagcgtttctgatccagctccccgtttttaataaggaactcttcaacaagaaataaactccc

SEQ ID NO: 339202 - DNA, 867 bp, Homo sapiens
cagctcggtaccccttacaggctttggagcaggccatgcctggcagtgatcagcacagacctgggatgggtaatgaacaggtggggtgggagagccccgcacctaccatctagtgtgtaagagctgcattcatacatctgactatacctatagcatattgtctcccccgattactactctagcccttgccaccttaatctaaggccagaaggaaaatccacctatggtagaccatggacgctcctcacagccaggactgaaggtggactgtaacagctggcttgttctaggacatttttaaccccagcactgctcaatgggataagccttgtcaccttacaacaatgtgtcttctcatttactgtttgtccaggtgctacatgtcagttaccaggcaccatgtgaaacaagacagaggcactgccctgaggaagctcacagcacagtgggcaggagaagcaaaccaacaattcccaaacagtgtgaccagtgctgagaggtgggaaggagtgtgatggggaggcagagagagcttctggggggagctctaggaaggggtaaccactactgtggctccaaagcctgtcaggggcataaactcagtgtggcaggtccctgcttcactgtcctttgacaggagcctctgagtcccatgctaggcacaagggacactcaatgaaccatacagcaccagtgtatggtagatgcatgtaacaatagcttcttaggaaacgagggttgccatgtggaggttactgggggaaggtgctatataatctgcatgcattttacaagtggatgaggtgcccccatccagccccccaccactagactgctgactgccctcaagttccccagataaaccct

SEQ ID NO: 339203 - DNA, 1466 bp, Homo sapiens
atacgatcgagctcggtaccaggtctgagtaggcctgtgagataattttaggaagatctgatggcacagcatggaagaaaatcaggtttccctacagaatcgctcccaaaagaaaacttattttggttaaatttctggatttaggtagagctgatatcaaaccctcatttggtctgttttatcaagcttggactgcagcagatgtggaactagagattcgtcacagattccagtaacatttaggaaaatgtttggctctgctattccagttcagtagaacaacttcgaaactggatttttctgtagggtgtcatcatcaccctgagatgccaatgtcatctgtgttgttatagtcttgggtctgctttgtgatccaatgagcccaaaagagtaaaatgccctcaaaggattgagaaaaaaaaaaggaaaaaacaaaacaaaggaaaacaaaaccttcccaattgagactttagcagcgttgtttagtgttctaaaaaaaaagaaaggcaatgaaactaatgagacctgtaaagagaatatgagagagtagggagagcagggtagatggaagctattaaacatttactatgtgtcagatgttttcatggtgtaatatcatttgtcttgtaaaagtcctctgtggtgggttttatcattttttattattttatttcatgaaggactgaactgaggctcagaggttaataatgccccacaggtcatgtagtaaattgtagaggcaggatccaaactgatatctttttgcctccaatgctcgtgttcttttctagtaactcatgccaccttcccatagacaaggttattttgttcccaagcttacttaacttcctctgcatgtcgtaaaatcctaaattcctaaattctccctgaccccaagtgaaagatccatttggatcaacatttttgttacagtgttgtttctactctgtgtgctctcttaagtcctggagcaatatgagattaattgttctaggtataataaactcatgcagtcaaatactatcacttcagctcacatatgtgaggcaacttgaccttgagttcgaattgaccaaggccactcaaacctatttgaactaaatgggtctggccaggtacccttcatactgacattagttttagatagtctaagggtaacacatgcttgaacaaacgtgattttattttaaattggaaataaaataacatctagtcagatgactgctgtttcaggctggaatgatgtctgacatcaatttctagcagctggaatccattccccaagtggcaaagcgtaccttggcctctataaccctgaagctcagccagtttcttaaggtcttctaatagaaaacagcaagatatttcttaagggtggttcagaaagcataatttggagttgattctaatcctagcagtgacctatgttaggcaaatgccttggatagtgctcagtcccctatgac

SEQ ID NO: 339204 - DNA, 504 bp, Homo sapiens
ggcttactgcaacctctgcctcccaggttcaagcgatgctcctgcctcagcctcccaagtagctgggactacaggtgcccaccatcacgcccggctagttttttgtatttttagtcgagacagaggttttgtctattggaactcatgatctcaagtggtcccacccacctcggcctcccaaagtgctaggattataggtgggagccactgtgcctggcctcaccctgatttctacagtatttcacaacttgggggcagcattagccaccagagaacatttgggaatgtctggagacattcggttgtcagaactggaggtggagggtgctactggcatctagtgggcagagaccagggatgcagctaaacatcctacagtgcctgggcctgcctccacaacacaaagaactgtctggtccaaaatgtcagtagtcctgaggctgagaaattgtagcttagaggcaccgtttcgcctggctgtgtgcagctgagccactcagtaca

SEQ ID NO: 339205 - DNA, 254 bp, Homo sapiens
aatatactgtatatgatcagtacacagcaggaaacctttctaatttacataattcattcccacacaaagctcaaaattatattccttgaacaaaatgcacatttatcagttgtcaacatctgttaccatttgtcactataacctaagtatgcatatagttaataattcagttgctttgtccttttacacaacagatgttgattgaatgctttcagtatgttaagagctgttgtagatgctggcgatatagaagt

SEQ ID NO: 339206 - DNA, 281 bp, Homo sapiens
aaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgc

SEQ ID NO: 339207 - DNA, 426 bp, Homo sapiens
caacaagagtgagactccatctcaacaaaacaaacaaacaaaatgtcaccgttagagagatacttctgtgggataacactagcttctccaataattcactattaaaatatcagaacagcatactccgtggcctgatattatcatatctcagtttatcagctttaatttatcagtctagtaggaagcagaggggagtgggtagcagatggtgagttctgatggagggcagagaaaggaggaaaggtatgatagcctaaatgtactagaaggaaatatgtattaataattttataatcttagcacagagccaggcgcagtggctcacatctgtaatctcagcactttgagaggccgaggtgggcagattgcttgaggccaggagtcccagatcagcctgggcaacatggcaaaactctgtctctacta

SEQ ID NO: 339208 - DNA, 223 bp, Homo sapiens
gtagacggcctagtatctaagtatctgacctgtgaccaggtatctctcccacaggaaatgttgatactggcagatattcttctggctcttgtctaacgtgtgttctctttatttctaccaagatagcgactctgtaggagagctctggccaggaggagagttaggttagagtgtgtcaagtgagacacagaggaggcaactcaacaaaacacatgaaacaaca

SEQ ID NO: 339209 - DNA, 525 bp, Homo sapiens
tctttatccagtctctcattgatggatatttgggttggttccaagtcgttgctattgtaaatagtgcaatctcttttctttataaattacccagcctcaggtatttcttaatagcaatgcaagaatgacctaatacagagacataagagaaagggtcccttggactgtctacctttgtaccatgttcaagtattacttatgtttttaaatatttgaaaagcaaaaataaataaaaagcaaataaagtaagacatctgaggaagaaacctggtttagctgatcttaagaatggttcagaaaacttaagaaagatgttaacttaagaaagatgtttggagataactaccgactcttgttaaccacttttcatggacaatttcaaggggatttgtctacccatcaccaagccctgaattatcaggtagaccgcaagtttccagagggaagaaggcatgggtttttgtacctctcctgtgacctagccaagcctctggaagagaatatgtacttgagaaatattaggtc

SEQ ID NO: 339210 - DNA, 363 bp, Homo sapiens
gaggatcacttgaggtcaggagtttcagaccagcctgaccaacatggagaaaccccgtctctactaaaattacaaaattagctgggcttggtggcacatgctactcgggaggctgaggcaggagaattacttgaacgcaggagatggaggttgtggtgagccgagattgtgccattgcactccagccttggcaacaagagcgaaactccgtctcaaaacaaaacaaaacaaaaacaaaaaacaaaactatatacaagcaattagcaggaattataaagatctaggaagtacaaacctgttccaggaatcgctctaacaattatctgtctctatccagactaagctctttgttgatggtaagag

SEQ ID NO: 339211 - DNA, 657 bp, Homo sapiens
cccccctcacacatgcacttttgggcctttttttatagctggaaaaaacaaaataccaccctacaaacctgtatttaaaaagaaacagaaatgaccacgtgaaatttgcctctgtccaaacatttcatcccgtgtgtatgtgtatgtgtgtgagtgtgtgaagccgccagttcatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactgctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttcctcgtgggcttgtgctcgggatcaaacctttctggcctgttatgattctgaacatttgacttgaaccacaagtgaatctttctcctggtgactcaaataaaagtataatttttacctgcg

SEQ ID NO: 339212 - DNA, 562 bp, Homo sapiens
gggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactacccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactgggggcggggagcacctgcctccctggtctgcgcctgggtgctga

SEQ ID NO: 339213 - DNA, 1055 bp, Homo sapiens
  misc_feature (44)..(44): n is a, c, g, or t
acaacaaaaaggcgcagccttttgtacactatgcccacggttantcaagcaggctggtactgcgtccgggttaccgggatatcgatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaaagccggaaccgcgcggtggtattgactacaagcgccgaccgaccgaaggacgaaggtcatacctttccaagggacgggtgaacaccaatcggtacaaccgtggcagcagcattcgaacgacagggctggaatggtaccggcaaccggatgggaaccggcaacacgcgagaacaaacggggcaaatccctgacacgaggacagaacatatagcgatggaaaggcacacacctgtgaaaccccgcaacagaggcgaccccgcaaagcaggggaactttccaacgagcgcaacacattttccccacacaggggagccattcggcacaattcccggggaccccttgtagtgcaatgtgaacccccgggttacaaattccatttacacagagtgcaccaccatagtgataaatttataaaaaaaacccttgtgtgaaaacaacggactcctggcagaatcgcgtataccc

SEQ ID NO: 339214 - DNA, 3741 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagccgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339215 - DNA, 3833 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcagataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339216 - DNA, 3676 bp, Homo sapiens
taaccctaaccctaaccgctaaccctcaccctaaccgcgtaaccctcaccctaaccgcgtacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339217 - DNA, 3882 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaattagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339218 - DNA, 2385 bp, Homo sapiens
gcaaagagctcccgaggaagcacagcttgggtcaggttcttgcccgctgcaggtctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339219 - DNA, 1887 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339220 - DNA, 4132 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgaaccaacacaaccaaaccaaaaaaaagccgccacccataaacaacccccaaaggaccaaaataaaagcaaccaagatccttggtcacaagggaccccaataagaacccgacaacaaaaaaaacacaagcccgcaataaacaccctaaaaccgccacaccgcacccagaaacaacaaaaaaccacaacaagg

SEQ ID NO: 339221 - DNA, 4339 bp, Homo sapiens
  misc_feature (3962)..(3962): n is a, c, g, or t
  misc_feature (3968)..(3968): n is a, c, g, or t
  misc_feature (3970)..(3970): n is a, c, g, or t
  misc_feature (4024)..(4024): n is a, c, g, or t
  misc_feature (4029)..(4029): n is a, c, g, or t
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgaaaaaaaaaaaaaaaaaaaanaaaaananaaaaaaaaaaacacaacaaaccaaaacacaaccaaaaaaaaaagaaacacacgnaaacnacacacacacaaaacgcgggcgagctgcccaacaacagaccccaccggacgagtggacccagacctgatgcccgacccaactacgtcgcaccagagggtgcccaatagatgcgagcgcaatacaacgcgagccgctcgagctacataaccgcggtgcgaggacaaaccgcacccgcggacctcagccgccaaccaacccgttggcggcgcaacatgcaccaacacaccgcacgattagcgacaggactcatcacaacggagatagaggaaccagacacaatacgtgcgcaacgaccagacgataacaatc

SEQ ID NO: 339222 - DNA, 1314 bp, Homo sapiens
aaccccatccatcaaacaaacaatacgctagtacagccggtgtaaatcggcagaggctgagccaaaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339223 - DNA, 3827 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttccccctcaaatgcattgggcttttataggtggaaaaaaatacacctaaagtgttttaaagaacgaatgccggtgaattgccggcaccattcggggttgttggtggtggggagcgcaccataggggggcatggggtggcccccgggggtgggacactggcggtgaattacacgtattcggggatttcgggcaaaacaaaagggggtgggtctgatagttttttccacggt

SEQ ID NO: 339224 - DNA, 2718 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacactctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339225 - DNA, 3541 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctttctggcctgttatgattctgaacatttgacttgaaccacaagtgaatctttctcctggtgactcaaataaaagtataatttttacctgcg

SEQ ID NO: 339226 - DNA, 1045 bp, Homo sapiens
cccccctcacacatgcacttttgggcctttttttatagctggaaaaaacaaaataccaccctacaaacctgtatttaaaaagaaacagaaatgaccacgtgaaatttgcctctgtccaaacatttcatcccgtgtgtatgtgtatgtgtgtgagtgtgtgaagccgccagttcatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339227 - DNA, 3553 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactgctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttcctcgtgggcttgtgctcgggatcaaacctttctggcctgttatgattctgaacatttgacttgaaccacaagtgaatctttctcctggtgactcaaataaaagtataatttttacctgcg

SEQ ID NO: 339228 - DNA, 2649 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcactgtggggaagggggtaccgag

SEQ ID NO: 339229 - DNA, 2602 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcatctgtcatgagtggccatacttctcgcggtagactgttcaccctgcagctgtacataataggctcccttgattgcatgacacagagggtatcacgggttgccgtgagcatggtagtgctccctctggcggatgggagaggaacacgg

SEQ ID NO: 339230 - DNA, 2664 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacactctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttatgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339231 - DNA, 1357 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggctctcaggaggaagctatggcccttgtggcaagtctgagctcggtacctgcgggagctccttaccctctggagggccaggaggcccaggggagcccgggacaccgactcgtgggtcacccttgaaacctttgggtcctggagctcctttctgtccatcttcccc

SEQ ID NO: 339232 - DNA, 1492 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctgatgatgacctgggtcgggaggtgcacggccttttccttcctccgtcttcccttcccttcccttcccttcccatctgttctcccttccttcgcccccttcctttcctctccctccctatcttccatttttctcttcttccttcacatcatttgtccaagacctccctggcctgagataaacataagttgcaaaagtggcttcctgcagcccattttccaggttgggaaactgaggcatgggcctaaggtcccacagccacaccgaggaaagcagcccccactgaatgtcaccatgcaccaaagtgcatggtcctcgtgacacaaagaggggagatgacagtggctggagttgtcagagctgctttgaggaagctccaggcctgataggcttgacagggccaaggggaactattgtggaatgtcttggccttgaatgacaggctgctgattttggatctggagaaagctcacactgactcttcctgctcccccagtctgtttttctcctgctactccatccatgtatccctgagtttgggccacagtccctccacttggtttgcatgtcccaccttctttgtttggcaagctcctattcatccttcaaagccctagcttcaatacctgctacttcatgcagccattgcttatccttcaaggagagcctacttccctcaaggaccctgctgcttccagtctcaccttctgactcactcgggatccactgaactgggaggtctgtgtctcctcccagcagagtcatcactacctttggggccgcaggatcacccagcttggaactagatacagaaatgctgttttgagagtgtactgaataaaagattacatgtttgaaaccc

SEQ ID NO: 339233 - DNA, 623 bp, Homo sapiens
  misc_feature (293)..(293): n is a, c, g, or t
  misc_feature (299)..(299): n is a, c, g, or t
  misc_feature (301)..(301): n is a, c, g, or t
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaaaaaaaaaaaaaaaaaaaaaanaaaaanangaggagcacgaagaagaagaccaacgagacgcaaaaaggcacgcgaggagaagggaaaggcacagcgagacagggcaaggaaggacgcggaagcagccgaaagagaagggggcggagggaagccccaagggacaagcaagagagagaggacagcagaaaagagcaagaggacaagcaggcaaaaagcaaaggagaagcgagagcagaagaaaagaaaaactgaagcgaaagagcgaggagagaaggggagagaggacaagaaaagaggacgaagcaaagaacaagacaggagaaagagaagggaggaagaagaagacccagc

SEQ ID NO: 339234 - DNA, 440 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgaggggctgggcggtgctggggcc

SEQ ID NO: 339235 - DNA, 540 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataaggtgagcccgggaccgggagacgcgtctttgcaatcccccgcagtgctccgaatccagggaggagagaagggccgggtctttgccgccttatccccgcgatcccaggagaatggagggagggcgagcgggcggtgtcatggggtgtggggacacatcccagtctgaaaaccaggagatctggggcgaggcgggaagtccacgcgtagcgggcagccgctgctggagaggggtgggctctgtgtcccggggttgggaggacgggagaggagcagggaagtcaggcgccggggtgtgttgggggaaggt

SEQ ID NO: 339236 - DNA, 382 bp, Homo sapiens
tgggcatgcagtgatgactggctgtcggcctacagtggggaccccatttatgacagcctggcagacgcaagcctggcagatgtgaatgaggccagtgcctccactacccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactgggggcggggagcacctgcctccctggtctgcgcctgggtgctga

SEQ ID NO: 339237 - DNA, 3941 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339238 - DNA, 3863 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339239 - DNA, 3653 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccatgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339240 - DNA, 3740 bp, Homo sapiens
aacgatacagagaagattagcatggcccctgcgcaaggatgacacgcaaattcgtgaagcgttccatatttgatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339241 - DNA, 2747 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgacctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339242 - DNA, 3880 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339243 - DNA, 3887 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339244 - DNA, 3829 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactgctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339245 - DNA, 4310 bp, Homo sapiens
  misc_feature (3995)..(3995): n is a, c, g, or t
  misc_feature (4000)..(4000): n is a, c, g, or t
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgaaaaaaaaaaacacaacaaaccaaaacacaaccaaaaaaaaaagaaacacacgnaaacnacacacacacaaaacgcgggcgagctgcccaacaacagaccccaccggacgagtggacccagacctgatgcccgacccaactacgtcgcaccagagggtgcccaatagatgcgagcgcaatacaacgcgagccgctcgagctacataaccgcggtgcgaggacaaaccgcacccgcggacctcagccgccaaccaacccgttggcggcgcaacatgcaccaacacaccgcacgattagcgacaggactcatcacaacggagatagaggaaccagacacaatacgtgcgcaacgaccagacgataacaatc

SEQ ID NO: 339246 - DNA, 3892 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctcttcaggtcaaatgttcagaatcataacaggccagaaaggtttgatcccgagcacaagcccacgaggtcgacg

SEQ ID NO: 339247 - DNA, 3589 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggagccagcatccccgctcccagacaactcccctcgcacgacatcagatcagactcccccgagccttacccaacctaatg

SEQ ID NO: 339248 - DNA, 4198 bp, Homo sapiens
  misc_feature (3883)..(3883): n is a, c, g, or t
  misc_feature (3888)..(3888): n is a, c, g, or t
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactgctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgaaaaaaaaaaacacaacaaaccaaaacacaaccaaaaaaaaaagaaacacacgnaaacnacacacacacaaaacgcgggcgagctgcccaacaacagaccccaccggacgagtggacccagacctgatgcccgacccaactacgtcgcaccagagggtgcccaatagatgcgagcgcaatacaacgcgagccgctcgagctacataaccgcggtgcgaggacaaaccgcacccgcggacctcagccgccaaccaacccgttggcggcgcaacatgcaccaacacaccgcacgattagcgacaggactcatcacaacggagatagaggaaccagacacaatacgtgcgcaacgaccagacgataacaatc

SEQ ID NO: 339249 - DNA, 3139 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339250 - DNA, 2673 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctcctcttcctagactccctcattactaagtcctgagcagaagggtccgtgcaatgtagccagccgggtggggggagcggcttccggcggccgtctggggtggaaccggcctgtcactcggttgcccctggtccctcttttctggcccggcgtggtgtctggcttccggggggggtggcccggttgtcgttgtgcggggggccttcggtctggggcgcgggtgttg

SEQ ID NO: 339251 - DNA, 1428 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcg

SEQ ID NO: 339252 - DNA, 1183 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacttcagtgttcatttttatttttcttgaaagtaaagatactcctgtaaaaattgccattgttccattaggaaaaatatttaactcattaagttttaaaggacaggtggataac

SEQ ID NO: 339253 - DNA, 910 bp, Homo sapiens
aattaggctaggtacgaggctggtgttgaatcggcaccgaggccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactacccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactgggggcggggagcacctgcctccctggtctgcgcctgggtgctga

SEQ ID NO: 339254 - DNA, 152 bp, Homo sapiens
tggagattctctgggccaagtttatggactgcaagccaggagcactgactcaaatggccccgaatatccatgctgtgattagctgcagttacaagtggcattttgttgttttgtttttgtttttttgagaaggggtctcactctgtcccggc

SEQ ID NO: 339255 - DNA, 185 bp, Homo sapiens
agcctgcgttcggtgacggggagatagggaacaggaagaaggagggagaggagatggctttctgctctccagatgctcgtcagccagtgagaagaagggtgaagggcacacctccagctgtgcctgggccaccctttcatggagctgtggccagttgctggccaggtaaacggcctgctcctccc

SEQ ID NO: 339256 - DNA, 292 bp, Homo sapiens
ttgtactggcaggggagttatgtgaagaaagaaggataccaaacagaagccacagggggactccattttcttttctttttgttccagttggggtgtgactcagtctggagtgcagtggtgtgatcatagctcgctacagcctcaaactcctggcctcacgagcatgatcctctcacctcagcctcctgagttgttgggattataggtacaagccatgcgcctagctcattatctttttaagttaaaaaaaaagtttttttgagacagagtgtcattctcttgcccaggctgg

SEQ ID NO: 339257 - DNA, 713 bp, Homo sapiens
tccactgcctatcccaaacctataagaataaatgataatcccaccaccctttgctgactcctttcttggattcagcccacttgcacccaagtgaataaacagccttgttgcttacactaagcctgctcaggtggtctcttatacggacacacatagtatttggtgctgaagacccgggacaggggaactccttcaggagactggtcccctgtcctcatgctacctctgtgaggagatccacctacgacctcaggtcatcagaccagccagcccaaggaccatttcaccaatttcaaatcggtaagcagttatttgcactcgggtaagcagtgtttttgctctctacctaacctctattgcctcccttcaatctctctcctttcaatttcagtttctctcccttcctggtagagacaaaaaggagacacactttatctgtgcattcaaaaactccgatgttggtcacggacttgggaagacagtcttcccttggtgtctgatcaccgtggggacacctgtcttgatcattcacccacattctcttggtggcaggtcaattatggggatgcctgctttggctgctcacccacattacagcccaggactcagtcagggatgcctacgggaagcctgtagttgccacctccatttctccgtgtctctaccttcctctttaaacttaccttctccactatgggcaacattctgccatc

SEQ ID NO: 339258 - DNA, 332 bp, Homo sapiens
tgtcaccttagtgggattcaaagaagctgaaatagacatgtgtttacccatcacgtttaaccagtgctttcagctctggcacctgctgctccggtcaccaaaccttccagcagccccctgacgacaccatctcctgtcctgacttctcagagttgtcttcttgggtgctagtccatgcctgctgaagtcctccagctcccaggagccatgttcccatgggtgcctttctgcacgtggctgcctcctctgagtcccggctgtggccccttccctgctggctcctgtgtggtgctgccagcctttgtcctgccctcgcccctttgcaggtagtg

SEQ ID NO: 339259 - DNA, 309 bp, Homo sapiens
aagacatcctactcagtggtctagtggttaggattcagcgctcccaccgccgcagcccgggttcgattcccggtcatggaaccaagaagtggagcaggacgagccgtggccaaaaatatcctactcagccctcctggcctgcttccagtaccagccccattgtaaaccaagttctcactgatttctcccctcttttaagttgtagcacttatggacaatagtgcttttttgtcacttgtcatttataatctgaaattcttttcctgtgaatgctcagatttaactagaaattaatgattacgcactgac

SEQ ID NO: 339260 - DNA, 256 bp, Homo sapiens
tgttcagttctgtctctctggagaactccaagtgctacaagtgcactttctgatttaattttttcaaacttacatgtttaaattacccatgagaaagactgttatcgtcacatccactttcctgaggaggaaacatgttcactagctccctagagtcacacacacaggtttaagctggatcagcctgactccaaagctagtgctctcattctcaacctgctgcatatgtgaaggcttcactgaaggcagacagtct

SEQ ID NO: 339261 - DNA, 588 bp, Homo sapiens
cagtatattcccgtcctacatagtgttaataacaacgaagtacactaaactaagaaagtaatcacacaaattttctgagaagcaatttctgctggcattcttcaccactgactacagctaaaggctgccacaggtctgacagtggcccctgcccactagatgccatcaggtcccccagtaactgtcagccacaaagtctccatacatttccaaattcctctcctccattaagaatcactgattatatattcattttaagaataacatttagaactttatattcccaaatctaaatttatcaaacataaatgagtcttaatataacaaaaggatacctgttatactttgtaaggggatttaagattccattaaataacagacatgctggcatttcaaagacaattcaacttaaattttcttttaacttctacccaacttctgaagcatgcagctattccacaaaacagtttatctatctagataggctactgtcctagagagttttagccagtacttatgggaagtcttctgttacttggagcacaacttttttacttagtaagactctgaagaatccttctactacca

SEQ ID NO: 339262 - DNA, 119 bp, Homo sapiens
tgtgaagctgcagccttcctaatcagtgacatgtttacaagaagttgagatatgcggaaaaagctggcagcagaaactttattcctaggtctgcataaaatcaaagtggcctggcagct

SEQ ID NO: 339263 - DNA, 216 bp, Homo sapiens
ccgaataaataaaatgagagtcaactgtctccctcaaagaaaaaaacctggaatttccctgacagggacaaaagtgggaacctcaaaacaaaaaatacaagaaatgtgcttctggctgttgtagagaacccatgtaatatagacaactaaggataagatggtctttcttctgaagccatagagcaactctgagaaatcaagtccagatactggctt

SEQ ID NO: 339264 - DNA, 215 bp, Homo sapiens
tcactttctttctaacaggcctcacgcttgttaattctactctgcaagcagcgagctttgtgttacataaatgatcacaattcagaatatataaatcataattcagaataagttatacattccctttaaatgaacttatgtaaatgtatttcacgtttgtacaaataagagaaaagtacggaaagatgctagccaaatttttaactaggaagggg

SEQ ID NO: 339265 - DNA, 307 bp, Homo sapiens
tgctgggattacaggtgtgagccactgtgcccggcccaatttttgtatttttagtagagatggggtttcaccatgttggccaggctggtctcgagctcctgacctcaagttatctgcccacctccacctcccagagtgctgggattacaagcatgagctaccatgccccatcctgctctctgcattttacagatgaggaaactgaggcacaaggaagccaaatgatggggtctctgggtcaccttgctagtaagtggtgagtggggaatgcaggctgtcctgccccagagtctgcccccctgactta

SEQ ID NO: 339266 - DNA, 270 bp, Homo sapiens
caatagagagtacaaaggtgaacaaatgaggacttctgagcagtggctgagacaagaagtgagagtttgccagaggatcccagatttgaagggaaggtaaaatgtcatatactgctatagaaggtactagcaaatgagttcatggctttaaagttcttggaactgtgcctggtatcttataagtactctttattacccacttttactttttaaatattcagctgttaatctttattttttaatttacctttgaggttcagggggtacatg

SEQ ID NO: 339267 - DNA, 321 bp, Homo sapiens
tcacccactagttgatgagtggtgctcagcaaatgaaactcttggttgtattaatatcagccttcacataatggcattagggaaaaaaataatacaaagttgattttttaaaaaataccaattgtagcactgcgttctgcctctgattgtgtagaaaatggagactccactgtcaggcccttggtccccttggaagacggtgctatctagtcttttcacagtccagcacgctcacactccagaacaaacactcacactccaacacaccctcacacacacactccaacacacacagatgctcgcactcacacacatcctccc

SEQ ID NO: 339268 - DNA, 304 bp, Homo sapiens
tctgcacaccgccggctcccccgacatgcagcttgcaccttcagtcactgtgcacaccgccagctcccccgacatgcagcccgcaccttcagtcactctgcacaccgccagctcccccgacatgcagcccgcaccttcagtcactctgcacaccgccagctcccccgacatgcagcccgcaccttcagtcactctgcacaccgccagctcccccgacatgcagcccgcaccttcagtcactctgcacaccgccagctcccccgacatgcagcccgcaccttcagtcactctccacaccgccagc

SEQ ID NO: 339269 - DNA, 1876 bp, Homo sapiens
tggctcagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacaaccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccctctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagcccatctgctc

SEQ ID NO: 339270 - DNA, 1548 bp, Homo sapiens
gcgctatctagaggatcccgttcgaggagactctacaggtaggtccacccaacgcccaggcaccccagtctacttgctgggctgagtccagccctggggaagattcctggggaatttatttgctgcttctcccagccttcccctgcccacaccacctgcgcatgcctggcacaaccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccctctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagcccatctgctc

SEQ ID NO: 339271 - DNA, 103 bp, Homo sapiens
atatgtgtttaattttctgaaataaattgagtttttagaaaatgatgaattacaatattatatgtaaatatgagaaatgtggtgttttttgtttgtttgcttg

SEQ ID NO: 339272 - DNA, 442 bp, Homo sapiens
catggcttcaaatactaattgtaggtatctattatatacagcctaaatctttctaagtaccagactagagtggcctaatggtcaatgtcatatgaacttggttttaaaacaaggcttgaaatgaattctccaactctagtttttctcaactctcgctgaaaggccatccactcttaccaaagttatagatacacacagatttgtgtgagtgtgtgtgtgtgtgtatctcaatttttagacagtatgctatagaatttgaggattcaaatacaaagaatctttaagataatgtcagtattagcagatgagacacatttaaaaataatgaaaaaggtgattaaacaaggtatctaatagctaatggtgaaatgtactgctgtaacaattctggattttatacagggtaatatatgaagaaaatgaggtactccggtcaaataaa

SEQ ID NO: 339273 - DNA, 273 bp, Homo sapiens
tgttctgaaagataaaccagactttgtggtttatgataagccaaagatatggtctgtaataaatagtgttgctagacagacactgtacggagcgcatcattgaggttgagtctccatctttaggagcttggcatcaacgacaaagaacgtgagcacgtaggaagatacgggagatgtactgacggtgaaatactaagacgctgactaatatgtgtgtctctttaacaggacttcactcacataattttgaatttattccatgagccaagacac

SEQ ID NO: 339274 - DNA, 312 bp, Homo sapiens
gctcccccttcatctatttagccacttatccatcagcaagcaattgttgcacgtctggcacgtgccaggcactgagcactggagattcagagacaacaacatagactctgcctggaaaatatccgcggggtagttcaagacagccatggaagccagcagtcatagcaaggactggtaagggtacagctaggcatagacaccacggggtcacagagaaggggcatggagggtaggccaggaggacaacagaaggcgttctgagctgactcagagaaatgggctaaccatgagaaggaagaagccatgtgaagg

SEQ ID NO: 339275 - DNA, 1073 bp, Homo sapiens
ctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactg

SEQ ID NO: 339276 - DNA, 1090 bp, Homo sapiens
tgtcaccaccgcgggtcacctgggagtcctgtgagtgcaccgccggggtcacctgggagccccgcgtgtcaccgccgcggtcgtcggggagccccggggctcaccaacgaggtcacctgggagccccgcgggtcaccgccgcggtcacctggaagtgtcacctgtgtcactaggtcacctagtgtatcacacaggtcacctagaaattcgtgtcaccgccaaggtcacctagaaattcgtgtcaccgccgaggtcccctgggagccccgcgggtgccgcacaagtgcccccgcccttccccccggttccgggtctccacgccctcctggtttgcgggcagccgcgaagccgcgagtggaccgagcgagtgcagctgcctccgcggggccgcgcctggccgccgcctccctttacctccggccgccccgtggcaggtgtagaagctgcagaggccgcagcagcccagcgcgccccttccgtgtggccgcatgccacccgcgccgcgcccaggtaagcaggtccgtgggtcgctgggtccatgcgtgggtccgtggctggccggggatggaccagcccctccccgcaggggcatcgcctgcccaaggacgcaggacccagtgagggaagcgcgcgctgcaggcacggggctctccaccctcgccatggttggcaccaagccacactgtgcactcgacacacgcagcgtcctggctgccacctgcagattccagctcgtgtctatgcagggccatggccgccatcacagggccatatgcaagaaactctctgagctctcctcgcccaaaaccgcagctatccttttgtggtttggtattataggtaacatgcccttccttaaagaaacagtatttcaggcctgtagtcccagctactccggaggccgaggcagaagctgaggcagaagcaggaggatcatttgagcccagaagtttgagcctgggcaatgtagcaagacccccccccccaacctcattccccaatcagttaaaagagagagagagagagagagaattccagcaggaagaagtacacatttccacgaatggtttgggaattcaagcatcatatg

SEQ ID NO: 339277 - DNA, 618 bp, Homo sapiens
tgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggt

SEQ ID NO: 339278 - DNA, 403 bp, Homo sapiens
aaaaaggaaaaacaaatgctttgcagaagccaagaaggaagtgaagggaaataaatgagagtggaaaaacgagagatcaattgtggtgagatatgctttttttggcaattaattgcaacaagtgcccaaaatgccaattataacatagtttgctatctaccattgctttatttaactgaagtattcaaccatagatatggaaaaaagactgacctagtttagaaaagttctatcctgatacatttaagcactagagagtatacacaaataaaaacacaaacttaacttttcttaaaaacttttactgagtcaaatattaaaagagaacacttgttggtaaagcatctcatgaagttgatttttgatttttcagtccttcagtaactaataatctttattttga

SEQ ID NO: 339279 - DNA, 379 bp, Homo sapiens
gaagcggcccgcgcttaagtacacggagacacctttcaaagtctttgccatcaggcagaaacggttcaaacctctcacttcctaatccccaccccatttttccaagcaatgtgactcaggccaggagcaagagaaagcacctcaggtatgagtatgcactcacctacatgagcgttttggtggatatcccgaggattcatgacagcctctagcaagaatgaatgaaaacagagatgtgagcttcctttacatttatgtcccttccctgcaacccaaacactttgctgttgtccttctgggctctgagcaggaccaacaaattggatctcttaatagttacttgatatggggagtctagatcgaccgcatagcaggcgca

SEQ ID NO: 339280 - DNA, 386 bp, Homo sapiens
cctatagagcgatccccgcgtcaaagtacacggagacacctttcaaagtctttgccatcaggcagaaacggttcaaacctctcacttcctaatccccaccccatttttccaagcaatgtgactcaggccaggagcaagagaaagcacctcaggtatgagtatgcactcacctacatgagcgttttggtggatatcccgaggattcatgacagcctctagcaagaatgaatgaaaacagagatgtgagcttcctttacatttatgtcccttccctgcaacccaaacactttgctgttgtccttctgggctctgagcaggaccaacaaattggatctcttaatagttacttgatatggggagtctagatcgaccgcatagcaggcgca

SEQ ID NO: 339281 - DNA, 241 bp, Homo sapiens
tctgatgtattttagcacagccatgcttcaagatggtggaacttaccctcctgtcttcccagactgatttctgttcctgccctgggtacttcttgtctcctctgaatgggtacgggagtgtggacctcagggaggcccccttggtatgctcctccgctttcattcggggatctcagacctaatttcagctttgcccaatgtgaaagcatttccagagcaaggtgacttcttcaggaatttt

SEQ ID NO: 339282 - DNA, 137 bp, Homo sapiens
ctggactcttcatcagtggtgtttgctaataaagttatctctgatctgttacttgagaggatgagttgggagttaactagggaagagagaagaagatggttccaggaatctgcagctcacagagtaagggagggtgg

SEQ ID NO: 339283 - DNA, 1096 bp, Homo sapiens
tcagcatgagtcagcggcaaacaccctcaagtcatgagctggaacgctcagaaacggttcactgagttttttttctcctattattttcaaatttattagttttacttaattatttttaaagtatctgagaaaatgttatagattttaagcgtgtttttattataacttcatgtcaataatttctccacagatatgtaccttcaatcaaattacagaattaactaggggaaaatgaggaagaactttaggtacagacagcgagagatcttcaaaatactattaaaagaagaaagcactctcggtgtaaaaaaggtaggaaaatagagtatctgtgttgctatataataacatatttgtgtttgttaataatatagatatttgtgtctgcataaagagacactggaaagatcaacaagaaaaaatgtggcccttcacctttgggacagtagcactgagtggacgctgagtggacgcagacaggagtggaggggatttcctagcacgttttttggagggttttcttgggaggggactacatactttattcaaaacattaatcataaaaagtaaacacaacagaaatcaccttacaactcttcaaatacacccattttgcacagacataatttcataagcatgttagtttcaagagctcattgacaacagcttaggacttgatgaaaacatgtcacgcaaaaaaatacaccataagtaactgctgattaccagctatgcaacactgaactatcatttaacacttgacaaatcactagccacggctgttttgaactccaacttaatttccttaacactggctcacatagctcaaaaaacaactccatcaaaatacacgtgaatcacattttaatccttaaatgcatgagcttttaaaagtgagcagttacacttcagcaatatttaaaaccggtcctttcgattttataactgaaataaaggaacgggctaagaagtcagtgccaagggtttaagagcatctctgcaaggcgctcagcctcccggggaacttgattagaatttccatctcccatacaatgagtattccccatatgctcatggcagataaactacatgtatc

SEQ ID NO: 339284 - DNA, 302 bp, Homo sapiens
aggcaggggatgcaacatgcaatggaagttgcattcctattactcaacctactctgcgttcaaaactccctgttcagtcagcaaatattattaaagtgcccactacgttccagatactctcttaggtactagggatatggaagtgaataaaacacacaatttcatcccttcatgagtaaaacatgtggtatgttaaatagtgataaatgggcagggtgtagtggttcacgcctgtaatcccagcactttgagagacatgcagatcacttgagcccaggaattcaagaccaacttggccaaca

SEQ ID NO: 339285 - DNA, 481 bp, Homo sapiens
tcacatttaaaattagaatagtccctgtcccacttaaaaataagatgaaaaaagcttttaaaaacttctttataattgacagagaaaaaagcagacaagaaaaagaacaaaaaataggatgaaaaatcacttctctttgtgccacggaaaaaaatatcacaagcttgtttgtgtttggcatccagtttatagcttggcaatctgagtctatgaacttaagccttcatggatgagtgcaccaattggcttttgaattacaggatagcattactcaattaactttaagactagccctttcaagcaatatagttagctgtggcacacaatatttcagttctaaaatgagaatgtcaactgtgaagctaaatttacaatttcagttgtttctctatcagccccctcccacacttactacaaatctgaataatacgactacaagaagcatttaaataaaaatgtgtgcattctaggcttattggca

SEQ ID NO: 339286 - DNA, 469 bp, Homo sapiens
ccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339287 - DNA, 181 bp, Homo sapiens
  misc_feature (30)..(30): n is a, c, g, or t
gcggccgcctactactactatacggctgtntagaagacgacagaaggggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339288 - DNA, 920 bp, Homo sapiens
ctttcctgtccgccacgttactgcttttttcgagacccttttctggagttactcccagcaagctgttactcagacgtcctgttggttaataaagctgtccctgcagcagttctgctattgtatagactcagtcttaaaatagtgggcttgatgtgacatatttcttcataatattgtgtatgtgcagcctctgtgtaattgcattatgcacctttattgcatagttgaagcagtggcaggaaaggatgccatatgtgttactgggagattattcagtgggtattttttctcactcttccgtttcagttaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcagtgagtgcctctgcggcgtcttgcctttagttcccatgagagggtggtggtgactgatttcattagatacagcagcccaccttcttctgaggctgagggacctttagttaaagttccttatgtttccacctaaaagaattggagggacctatcagagtacagtatgtgggatattgtttgaaatgagaaaattgtgacaaagagaacacaggaaaatcaagatgaagccagggtaaagagagtacttagaagcattctttaaaatacagcacactgtgaaaatttggctcgattttcctagtagccaatgcagaaagagaaatgagttgagtgggataatctggtaccccagaaaagcatggctgttccggctctgaggcttgagagg

SEQ ID NO: 339289 - DNA, 368 bp, Homo sapiens
gcgtcgacggaaaatcaagatgaagccagggtaaagagagtacttagataggtccctccacttcttctgaggctgagggacctttagttaaagttccttatgtttccacctaaaagaattggagggacctatcagagtacagtatgtgggatattgtttgaaatgagaaaattgtgacaaagagaacacaggaaaatcaagatgaagccagggtaaagagagtacttagaagcattctttaaaatacagcacactgtgaaaatttggctcgattttcctagtagccaatgcagaaagagaaatgagttgagtgggataatctggtaccccagaaaagcatggctgttccggctctgaggcttgagagg

SEQ ID NO: 339290 - DNA, 541 bp, Homo sapiens
tgttgctgaggtgactctagattatccctcagtaagcggagcatcagtaacggagcatcagtaagcggagcgtcagtaagcggagcaacacaacatacccccagcaggcgtgactccgctcggaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339291 - DNA, 1363 bp, Homo sapiens
tgttgctgaggtgactctagattatccctcagtaagcggagcatcagtaacggagcatcagtaagcggagcgtcagtaagcggagcaacacaacatacccccagcaggcgtgactccgctcggaccaggactccaaaatggcgtcagttgtaccagtgaaggacaagaaacttctggaggtcaaactgggggagctgccaagctggatcttgatgcgggacttcagtcctagtggcattttcggagcgtttcaaagaggtcagagccttgtggatgtctgtaaatgaaagcaaatctctgggtcttcagatctcttttttgccatgaattaatttgggcaatgaaggccttgttgtctgaaagcagtaagttatgtagaggatgacagggagggatgctaggccttggacttctgtggttgattggccctttcaaaggctggctctgagatattacagccaagaacatgtttcctgttgcttggaatcagtatgtctgcctctgtcttagagaaatcctaagacttctttaagaggaaaatgaattggaaccgtagtgggcattagtctataatatgatgctctcctccctgccagaacttcaggacaaatatttgaaatggcctatcttggcctggtgtggtggcttatgcctgtaatcccggcacttcgggaggccaaggctggaggattgcttgagccgagtttagaccagcctaggcaatatggagagaccccatctctataaaaaaaaccacacaagaaaaattagctggctgtggtggtgcatgcctgtagtcccagctactcaggaggctataagctcacagccaaaggggagaggtggaatccaggtaggcctagttcaggagctggtatgtgcttatagttcaggctatggggatgagagaccttactggcatttgtgcttgtcatctttatcagccagtgaatgcagggcgaggggcttaaacagccagagcaggactaggtccctgaatgtcagccagactcaactgtgtgctcaacttcactcaaatgtgaagcccagcagggcagtgagcgcctcttgcgtttgcaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339292 - DNA, 335 bp, Homo sapiens
gtggcgttctagaggatcccgacagcacagaggaggtggacacaaagaggtcgttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339293 - DNA, 334 bp, Homo sapiens
ccagcagccctcgcgcggtccggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339294 - DNA, 499 bp, Homo sapiens
ccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtgctgattgcctgcctgtctgccgtagccat

SEQ ID NO: 339295 - DNA, 778 bp, Homo sapiens
  misc_feature (472)..(472): n is a, c, g, or t
ccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtaanaaaaaaaaaaaagaaaaaaaaaaaaaagaaaaaaaaaaaaaaaaaaaaaaaaaagaaaaaaacaaaaagggggggggaacacaaagtagaagatccacacagggggggcaaaaaagtagagcacgccgccggaagtatgagagagagagagaggacgcaccaccacagagagaagagagggtgcacaagcagacagcggaggaagagagacgcggacgagcaaaaaaagagagggagagagagaaaacgaaagagggaagaagaggaaaagagggagagagagagaagcaaagagagaggggaaac

SEQ ID NO: 339296 - DNA, 741 bp, Homo sapiens
ccagcagccctcgcgcggtccggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtaaaaaaaaaaaaaaaaaaaaaaaaaaaaattggggggcgggggcccggaaaaaaggttgctataaaccacaattggttggggcgcgccgcgaggacccacggatgggaaagagaaacaggggccagaaccagggtgcaccaaggaaaaaacggggacaaggaagaagagcggagaattgaccccaagataaaaaaagcccgtgaggaaacgggcgagttggaaaagaacacgaaagagagacggaggacaaaacgggcataacaagaggatcaagaagtcaataataagg

SEQ ID NO: 339297 - DNA, 392 bp, Homo sapiens
ccagcagccctcgcgcggtccggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacctgaatcctttcatatcctaataggaattaacctccaaataaaacatgactggtacgtgt

SEQ ID NO: 339298 - DNA, 1585 bp, Homo sapiens
tgttgctgaggtgactctagattatccctcagtaagcggagcatcagtaacggagcatcagtaagcggagcgtcagtaagcggagcaacacaacatacccccagcaggcgtgactccgctcggaccaggactccaaaatggcgtcagttgtaccagtgaaggacaagaaacttctggaggtcaaactgggggagctgccaagctggatcttgatgcgggacttcagtcctagtggcattttcggagcgtttcaaagaggtcagagccttgtggatgtctgtaaatgaaagcaaatctctgggtcttcagatctcttttttgccatgaattaatttgggcaatgaaggccttgttgtctgaaagcagtaagttatgtagaggatgacagggagggatgctaggccttggacttctgtggttgattggccctttcaaaggctggctctgagatattacagccaagaacatgtttcctgttgcttggaatcagtatgtctgcctctgtcttagagaaatcctaagacttctttaagaggaaaatgaattggaaccgtagtgggcattagtctataatatgatgctctcctccctgccagaacttcaggacaaatatttgaaatggcctatcttggcctggtgtggtggcttatgcctgtaatcccggcacttcgggaggccaaggctggaggattgcttgagccgagtttagaccagcctaggcaatatggagagaccccatctctataaaaaaaaccacacaagaaaaattagctggctgtggtggtgcatgcctgtagtcccagctactcaggaggctataagctcacagccaaaggggagaggtggaatccaggtaggcctagttcaggagctggtatgtgcttatagttcaggctatggggatgagagaccttactggcatttgtgcttgtcatctttatcagccagtgaatgcagggcgaggggcttaaacagccagagcaggactaggtccctgaatgtcagccagactcaactgtgtgctcaacttcactcaaatgtgaagcccagcagggcagtgagcgcctcttgcgtttgcaggttactaccggtactacaacaagtacatcaatgtgaagaaggggagcatctcggggattaccatggtgctggcatgctacgtgctctttagctactccttttcctacaagcatctcagtgagtgcctctgcggcgtcttgcctttagttcccatgagagggtggtggtgactgatttcattagatacagcagcccaccttcttctgaggctgagggacctttagttaaagttccttatgtttccacctaaaagaattggagggacctatcagagtacagtatgtgggatattgtttgaaatgagaaaattgtgacaaagagaacacaggaaaatcaagatgaagccagggtaaagagagtacttagaagcattctttaaaatacagcacactgtgaaaatttggctcgattttcctagtagccaatgcagaaagagaaatgagttgagtgggataatctggtaccccagaaaagcatggctgttccggctctgaggcttgagagg

SEQ ID NO: 339299 - DNA, 451 bp, Homo sapiens
ggtcctgcctctgaaggacgggttctctggggctgtttgtctgagcgtgtgttccctctgttccttctggaaagaaagtggttggccaggtggcaggttggctcctgaggtgtctttgtgccccccgggtctgctgattctgcagagacaccggcaggcgggtcatgggtcatctctgaagggaattctcaggaaggctttgtgtgatctcagcctgcttcctgccatgctgtgccttcactgtaaccttttaagatacttaccatcttgccttcctgacttcagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339300 - DNA, 451 bp, Homo sapiens
ccagcagccctcgcgcggtccggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 339301 - DNA, 757 bp, Homo sapiens
  misc_feature (757)..(757): n is a, c, g, or t
ccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtaaaaaaaaaatctgcacttcctctccgccatatcataatctctattcttctgatcccacgtcacctttcccgtgcctttcctccacgtccaatttgcccctaaagaaaaaaattgtggcggcctttggccccattcttctttaaatctcgagcctgtttataccttcgcggccgttgtggccttctttggcaacattccccccttatgggggcgccgttttcttaacggggccccggtctttttaaccacgcgcggaatttgtgaacacccctttggggtttccctcn

SEQ ID NO: 339302 - DNA, 829 bp, Homo sapiens
  misc_feature (829)..(829): n is a, c, g, or t
tgttgctgaggtgactctagattatccctcagtaagcggagcatcagtaacggagcatcagtaagcggagcgtcagtaagcggagcaacacaacatacccccagcaggcgtgactccgctcggaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtaaaaaaaaaatctgcacttcctctccgccatatcataatctctattcttctgatcccacgtcacctttcccgtgcctttcctccacgtccaatttgcccctaaagaaaaaaattgtggcggcctttggccccattcttctttaaatctcgagcctgtttataccttcgcggccgttgtggccttctttggcaacattccccccttatgggggcgccgttttcttaacggggccccggtctttttaaccacgcgcggaatttgtgaacacccctttggggtttccctcn

SEQ ID NO: 339303 - DNA, 747 bp, Homo sapiens
ccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtaaaaaaaaaaaaaaaaaaaaaaaaaagaaaaaaacaaaaagggggggggaacacaaagtagaagatccacacagggggggcaaaaaagtagagcacgccgccggaagtatgagagagagagagaggacgcaccaccacagagagaagagagggtgcacaagcagacagcggaggaagagagacgcggacgagcaaaaaaagagagggagagagagaaaacgaaagagggaagaagaggaaaagagggagagagagagaagcaaagagagaggggaaac

SEQ ID NO: 339304 - DNA, 390 bp, Homo sapiens
ctatgactcaaagtgaatcctgtcttgattttgagttctttttgtgtagctcttttttctttgtagttctgccccacaacttcagtcatctcagcctgacctttgtttcttcaacttgatatatctccagtgctctccttgggaatcccttttccctgatccttcaggcaccaattcaaggggaatataggggtcttgttggttttcctactctgagggatcagggtcccgtggtgtctttatttaatgactgaaaaaaatttttttcatatattttgcctacttttctacttgattacagcaggaaggtaaacctggttcctaataaaccatcatgactggaagcagaagtttggctcaaccttttaatattttggtcatatgattttt

SEQ ID NO: 339305 - DNA, 484 bp, Homo sapiens
aaaggagacttcattgttgtggcggggaggagtctcggagaactcacatggaaacattttaattatagttcactctaacatctttgaacaagcaagctgtcttcactggctccctccaagcctccatgcagctgctcttgcaatgcctagacctgccccaggcagcactcagtctcccagactcgtggagcatcctagggagacccttacttcctcaaagttgctgatctgaacctcctccctgcctagcaacttgggtctcagcattcccagcctggtctccctggagagtggcttttagcctgagaattggagacccagcctgaggacactaaggtacttgtggagaaaatactttgacatcttgatcccactgtccccaccctttcacagcagaaaaatgcccctcccacccttcagtcacttcggcacaatcctgttctattctttatctgcaatcgcacattgtgctctcaattttatt

SEQ ID NO: 339306 - DNA, 186 bp, Homo sapiens
tccccatcatgtagcttatattctgttgggggtgatgggggggtataaagttagcacatgtagggcaagtaagtgtgaagctatgtcatagcagtaaatgcaatagggtttaagaaaaagaagtcaggaaaagggtcatgaaagatgacatttaggctaagcttagaatgataggtgggattttga

SEQ ID NO: 339307 - DNA, 625 bp, Homo sapiens
agaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataatgacaataataacaatagcaatattatctgatctctctgggcctctgttagccagctataaactcagtctcattccctgtccgttccaactttactgtgttcttttaaaaaccagaccacgggctgggaaatgccttgatctttactgaccgagttgtatattgggcctagccctagccctgttaaggggcactgtgtggaaatgcccaggctctccagattgaaacttctcactcttcaccatccagttgtccagctgcagcaaagcacatacagagtgggagttagagcagtccctacaggaccaggcactgctgaaagcgcagctgacacaggtgaggttttccgagggagggatgtggaaggacgatgaccccaggtggccaggagcaggtgaggaccagtgacagcccttccta

SEQ ID NO: 339308 - DNA, 638 bp, Homo sapiens
caagtggaacatcagctggaagaagaaaagaaagcaaacaacgagagacagaaagccgaaagggtgctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagct

SEQ ID NO: 339309 - DNA, 251 bp, Homo sapiens
ccctcccacttgagctcttcactgatcaagtactgtctgccagtggaggaggtataatgagggctcccaggaggcaccccacctgggcatctgaggctgcactacaagcaggcagagccagtctggggccgcgggagaaggcagtagactgaggggtgttctggcctcttctcatgggcaagactaccctgcaacgtttaggtccaacagtttccctagggctaaagtgtcctagggatgggcatccttgg

SEQ ID NO: 339310 - DNA, 283 bp, Homo sapiens
aacattacaaataaaaagatgaaaatggtagaagattctaaatagagaaataagcattaagggatagctttgctcaaatatataaaacaatattatgataaaggacacaaactagttgttgtgagcctccacagaggacaaaaaatgtaatcatgaatgttcaaatagatataaaaacaagctgttataaggatgattaaatgtcgctacaggccagcaaaaaagtgtgcagaattagaatatgttttaaatcatataatagtaatcgctaatgttagagata

SEQ ID NO: 339311 - DNA, 218 bp, Homo sapiens
aacattacaaataaaaagatgaaaatggtagaagattctaaatagagaaataagcattaagggatagctttgctcaaatatataaaacaatattatgataaaggacacaaactagttgttgtgagcctccacagaggacaaaaaatgtaatcatccttataacagcttgtttttatatctatttgaacattcatgattacattttttgtcctctgtgg

SEQ ID NO: 339312 - DNA, 692 bp, Homo sapiens
tgtttccatttgtccaatgttcggtgttagtgttttactattgtcttttgagtaactgagtttcatcactttttatttctttgatttgttctttttatgatacccaaatttggaactctctttattcttcaggtgattctgctttgagtacgatctagtcaaaccctacactcagacattgtggaatggatgatacactgcttttaaggcagtttggaaggaggatgatttaaatgaccttcaaagactaatgtcaagcccccatgtcaatgtcactgcaattcatgcatgcatggagaataggaaaggaacttaattgtggaggaggggaattgtaaccctgtttgaatgggtagttgaaagtcctgggcccgcccctaaggctcaaaaaaggactttcttacatttgctgccaagaggtcagagggagagcccatataaataccatcctcccgcggggtgtgtgagccagtcttattcttttacttccacaggtgcagaacaggttcaccaaatagtattctgatctcccttgaacagaatctgacatcatattgtccttctctagaaaatcaatccctttaaagcatggaacatggcaattttaggtcagtaggcatttaaagacacctttttaactttcaagggctggcctaataagatatattttgtacaaaataccagtgttatca

SEQ ID NO: 339313 - DNA, 429 bp, Homo sapiens
ttgatatggatgaaaaatgtgtgaaaatcaccaagaacttattaaaaaagacaaagaagagctgcttttctttccccccatgagacagagtctcactccatcacccagggtggagtgcagtggtgctatcttggctcactgcaacctccgcttccggggttcaactgattctcctgcctcagcctcctgagtagctgggattacaggcatgtgccaccatgcctggctaatttttatatttttagtagagatggggtttcaccatgttggccaggctggtcttgaacttcttaccacgtgatccgaccgtctctgcctcccaaagtgctgggattacaggcgtgatccaccgtgcctggcctgtttggtttttttaattgcggtaaaatgttcgtaacagaaaatttagtagcacagaacaccgtcgag

SEQ ID NO: 339314 - DNA, 680 bp, Homo sapiens
gacagcagtataggctatgtataatttgtttcagtatggcatagagagacacaaatggatcattttagatttctcttggtgagcaacacttctattcatgaggtattttgttttcgattggctttgtactttgcaaattccacttgagcctgtgtaaaaaatagatcttattcccaataaagacatcatagcaaagatacaagtgtttgcctgggaattattttacatgaagttgtgctttgcttatttcttacagaactattgtaaagccctttgtcctgtattagagagagagagagagagaggttttaaaagcaagacaggagccttggcttctatataaattgtgcatattactacttgacacaccatcttgaccaaggcccagcctcatcttaatctttgaaaatgcctgtctttcaagataccacagtttccacccttcctgccttccatcattattttgtaaacacctgctgcgtaacaccacctctttgatttcagactgcctgggttagatggaaggattggtttatgtatcagaggagcccccactggaggaagtgagccttgtgttttcagcattgagtggatatatgttgagcaaaagaagccaaatacaaaagcatacatactaaaggatttcatttgcaaaaagtacaaaagaagcatggtaatag

SEQ ID NO: 339315 - DNA, 190 bp, Homo sapiens
tatggcaagatacaaaaccatttgtttcctaactgtgttctactggattacacaaagttaaagaagtgacaatattgaagggcttctcagagccttttataagctaatatgtaacgagtttctaagaggagagtagtgaatgcagtgatgttttatttgacctaggaaaacttttctcaaggaacaccta

SEQ ID NO: 339316 - DNA, 285 bp, Homo sapiens
actggggaagtcatcggcaaataaggctctcacagagaaaacatacatgcccacattagctcctgagaagccaatcatcagattactgatggattcagaaacagactcttatgaagattgataaaatctgaaaagaacccacagtgatgctcctgccaatgtcaaatgtaaagtacaggatgctgtcaaaagaatttttttcagaccatttactccaaggaaaccaagtcgacacttgattacctctctgttcatcctgagttgctgcatactggcagtaacaac

SEQ ID NO: 339317 - DNA, 357 bp, Homo sapiens
ccaacaggagcttgggcacggtggctcatgtctgtaatcccagcacttcaggaggctgaggatggaggatcccttaaggccaggagttcaagatcagcctaagcagtatagtgaaatctcatctctacaaaaaatataaaaatgagccaggcgtggtgacacacacctgtaatccttgacacttgggaggtgaagtgggaggattgcttgagcctgggacttcgaggctatagtaagctatgactgtgcctgcctggggaacagagcaacaccttgtctctatataacagtaaataaatacataaataaaatctaactgggcatgtggccatagctgcagtgtttcccgacttcatg

SEQ ID NO: 339318 - DNA, 430 bp, Homo sapiens
taacgaggagttttctttttataacaaagagagtacatttacaaaacttaaatacaattctgttcatccttggattactgtgagtttgagttagggagggcagagctggattatctagttagtggcttccatgatttttcatgtctgtgaaaatgttgaaaacatactagatgcagtttcaggacatgtggtttcttaatatagtttgcatattttgaattccagaatctgtgtaggcattttgccaatggcatgtaaattgtggttcacagaccaccaggctgccttgtgcattctttttttttttttttgagacctagtctcagtctgttgccaggctgcagtgcagtggtgcaatcttggctcactccaacctctacctcctggtttcaagcgattctcctgcctcagcctccctagtagctgggac

SEQ ID NO: 339319 - DNA, 451 bp, Homo sapiens
cacagtggaggaggtgagccttaaagagatcgataagggtttgcccggcagaagaaaacagcgtgagcagaggcatggagtctgcagtagaactgcatgttaggtgaacctgatatagggtcaggaggggtagcaggagagatttctggacaggctttcacacagtgaatcgtggaagctcccccaaatcacccagccaaagcccaaattataaagatccaacatcctcccactgatatgctcctcatggtgtgagtcttccctccttgcaacaagtaataaaccaaacttgcttgactacagagtgtttctggtggtcgttactggaggacattcacaactgtaacagtgaaaaaggatggttaagtttcttgggggaagttaagggagtctcattctgagggctcccattttctatgttaagcaataggtgaaattatcttatttattt

SEQ ID NO: 339320 - DNA, 341 bp, Homo sapiens
aaattaaaaccacaatgagatattatcttatattcatcagatgactattattaaaaagacaaaaaccaaaaacaaaaacaaatgttggtgagatgcagagaaaagagagcatttttatactatttgtgggaaagtaggtcactacagactctatggaaaatggtatggacagttctcaaagaactaaaagtagaactaccatttgacccagcaattccactactgggtatctaccttaaagaaaataaatcatcatataaaaagatacctgcacttatatgtttatatcagcactattcacaaccctaagtgtccatcagtggatgagtggataaagaaaa

SEQ ID NO: 339321 - DNA, 351 bp, Homo sapiens
  misc_feature (18)..(18): n is a, c, g, or t
  misc_feature (24)..(24): n is a, c, g, or t
tatacacagatgagtcanctattngttactggatatatgggtaaacattatgggagctgaaggggtggtatcagcgctataccaccaacttcaacaattcctattcttcattagtaaatgtttagagttgtttgaacttctcggatgatatatggtattttgggtaaaacctatgtttatttttgctactgtattgtatggtagtttgataatgtcttaatttatgctctattttgttctgatgaggattttaagagtttgtcactactgtttttaaaagcaagtaactatttttaaattttttttaaagacatggtcttgctctgttgcctaggttggagtgcggtggta

SEQ ID NO: 339322 - DNA, 863 bp, Homo sapiens
ctcccaggttcaagcgattctcctgcctcagcctcccgagtagctgggactacaggcgcacaccaccaccacgcctggctaatttttttgaatttttagtagagacggagttccaccatcttgaccaggctggtcttgaactcttggcctcaagtgatccgcctgcctcagcctcccaaagtgctaggattacaggcgtgagccactgcacccggctgaggtcctgttcttaactatgcacactgcccgtgttccttggtcatcacaagattacatacccactgctgtcttcctttgttcaagcttcacaagatgtcccagcctttctcctttccttttagattcttctagttgttatctatattcaatccatttctacagaagctttgatactgcccagtggaaccagtcttataaatattttactcttaagacttttcaacagagaaaaaagcccttaatcacagtccttgcaagaggcaggtgctgcctgttttctttttaaccaattagtgaaaacagctgcaggcttttgatgggatgacccagagaggctgttgtaagcgttgcattggcagaggaacgccacagcatgaaggcagggaaagtgctacaaaactagatgtgtaagggtatctctggctttttcttttgtttggctttatattcctgtgaattaggtagaagcaaggtgttgtctccatttcaaagatgtggaaaatgagtataacgaagatgctgatcaggaagaaggtaagatcccacagcatagcagcagggtgatgtgatgtgggtgaacaggagatgggatgcctttttcccaatctgggtgctgcacttgagcagtatgaactggtgccagt

SEQ ID NO: 339323 - DNA, 393 bp, Homo sapiens
gcacacacaaaataatattatttcactgcaccagattctgcagttcagacaaatgaactatgtaaatgtgaatctcagaaagacacaaaatgagctcaaccagggatgtgatgaaaaatgggaaacacatggataaacctaaatatacgaatgaatggcaagtacataatgcatgttgaatgtttatatactgctgggaagtatagaattactttgaaaactggtttggcattatctcctaaagttgaaattgtacatacccagccttattcttgagtaatttttcttgtcaattctatttttctgttgtgagagtgatcatggaaacagtgggtgagaacactggtctgtctagtccattcttgtcttgctattgaaacttctaaaactagg

SEQ ID NO: 339324 - DNA, 938 bp, Homo sapiens
ctgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctat

SEQ ID NO: 339325 - DNA, 609 bp, Homo sapiens
catttggaaattatttttatgaggattttcagacatttgaacattttcaactggcactgaaagttgaatactgcttttagaataacaacagaaaatcaaagcctgtatgttccttttcccttttacttgttaagcaaatcttgaagaagttacttgactcattgttctgaatgtcttaatcagtcactttaattttttgaaagaatttccttgaaagtgttcttaaataaaaatagggatcttcctgttagtgagtgtaaaattactcagcagtgattctttggttttgtgaaacttaagggaagactaactcttctttctctatcccttccttccattccctctgcagtccatcatcttggttcaggcctttgtgacagttcttgcctagcctcccaaaagatagctttccccacttctcctgcttgtcagtgttttcaaccacctgcagatgacttcttcaggtcagcagtagttgtcacttacctcttggaccaaccttttgggattccttattgcctgatgaatttaatggatttcttaccatagtattccaggtcctgataatctgctcccaacctatagctttctagtcttcctctccctcat

SEQ ID NO: 339326 - DNA, 1879 bp, Homo sapiens
tataccgtgaggagtggggcggctgtgtagacacctgatctgccggtgccttggtcttggacttccagcctccagaactgtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggctcaaccacagcctgtcctacgacgtggcctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgctggggcaccgtgtgtgacgacggctgggacaagaaggacggagacgtggtgtgccgcatgctcggcttccgcggtgtggaggaggtgtaccgcacagcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaacactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaac

SEQ ID NO: 339327 - DNA, 2007 bp, Homo sapiens
gtagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgctggggcaccgtgtgtgacgacggctgggacaagaaggacggagacgtggtgtgccgcatgctcggcttccgcggtgtggaggaggtgtaccgcacagcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaacactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaac

SEQ ID NO: 339328 - DNA, 507 bp, Homo sapiens
tataccgtgaggagtggggcggctgtgtagacacctgatctgccggtgccttggtcttggacttccagcctccagaactgtgagcagtacatttgtgtttatgagccaccctggctgtggtactttgctgtggcagcctggactaaggcaggggggctggctaagccaggactgagggctcaagcgatcctgctgggtggcctcagggcagaaactgctggtgaggctgtgaggttttgtggggaggagtttttcgaggagcacccaaagtcctagggcgcctcatccccatcctctttgccccgacctgctgagctccctcctctggcatggcctgctgtgtttttcgtgcgtaagtagcagagctggaggcttcagggacacggatgactcagtcctctacaagtggcaggggaggctctcagcatttctgtctcccaagccagacacccttcccactgaatggtggtaggaattgggagagtgagacaggtgtattcaactcat

SEQ ID NO: 339329 - DNA, 2296 bp, Homo sapiens
gtagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggctcaaccacagcctgtcctacgacgtggcctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgctggggcaccgtgtgtgacgacggctgggacaagaaggacggagacgtggtgtgccgcatgctcggcttccgcggtgtggaggaggtgtaccgcacagcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaacactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaac

SEQ ID NO: 339330 - DNA, 227 bp, Homo sapiens
tggcaacgtactttacccttacaatattgattttcacaactgttaattatcaaacttttttataatttaaaggtaaaaaaattatctcttttctatctgcatttcctggatttataaagctgaatgctgtttttaaaaatcattccatttctcattttataaactgcctgttaacatacaagatgttcttcaatcatcaaaaaaacctaacctaacttgtttgctat

SEQ ID NO: 339331 - DNA, 390 bp, Homo sapiens
tgttcaaccagggcctcccaccctgaagagcagggcatgctatagcggccacaggtgtctcggtatgttgggccagtggagttctttgtggagtggggttatggagcatgtcacatttggggctgggacaggaatgaggatagggatggcggaggagtcttttaaagacatctctgtaccctcccctccttcctacttaaaccctctgtgggttctccattgtcctcagggtacactttgacttcctcttcctgatgcaggcctgtccctgtccatctcccacccttttctctgccagtctgcccttctgtctcctggaatgccccctgtgcaatcctgcccctttgcacatgctgttccctctgtctagactgtcctttcacctcttca

SEQ ID NO: 339332 - DNA, 333 bp, Homo sapiens
gatatgtgccttgatcgattagtgatgtctgccttgggcccaggaagagaaatagacttacacgtgtgttgcataccctgcccagatatgaatgggttcactcaatagtgagagacacaaatgagccttaaataggagcagggtcagctggtgtggggcagggggtgcaaggtgggatttcgtaccagggaaacaaaaatgggtatgaagtaagttgttaccattttaatgaaactgaggaacagagaaaaacacagaaatttctctgtgtctctctttctctgggcctatctctgtctttctgtccctatttctgtctcttgctgtctgtcc

SEQ ID NO: 339333 - DNA, 356 bp, Homo sapiens
tgccacagatccagcatatggcagaagaggctcttaccactcctggactgcttttaaaaacaaacacaaacatgaaacaaaggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccactttaaaaaagtct

SEQ ID NO: 339334 - DNA, 1600 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagcactcgatccacagtcaagagtaccacttttcacgatatctctaggatatggacatcttcctccttctctgcacatcaaaacttacctgtccattgtcctatgcttctggggtgctgcactctactttataaagggtatcccatcgtcctgtgtaagccccgagtctgctgcaccgggtgataatgccagactgcttgggcgctgctgcacatcctcaccaaactcctgaactcctctctggaccacacatctcctgtgtgggctctgtctcccacactctgtttctggcacaaatctacgtctcttcaagaagaatatagttccgagttttccaggaaactcttaattgatgtctagtcaagatgacgtgggtacagaatgacagaatgggagtcagatgtttcttgatgctagtacatgcttgctggaaggcagttatgagcctaatttgcaggagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccactttaaaaaagtct

SEQ ID NO: 339335 - DNA, 1603 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagcactcgatccacagtcaagagtaccacttttcacgatatctctaggatatggacatcttcctccttctctgcacatcaaaacttacctgtccattgtcctatgcttctggggtgctgcactctactttataaagggtatcccatcgtcctgtgtaagccccgagtctgctgcaccgggtgataatgccagactgcttgggcgctgctgcacatcctcaccaaactcctgaactcctctctggaccacacatctcctgtgtgggctctgtctcccacactctgtttctggcacaaatctacgtctcttcaagaagaatatagttccgagttttccaggaaactcttaattgatgtctagtcaagatgacgtgggtacagaatgacagaatgggagtcagatgtttcttgatgctagtacatgcttgctggaaggcagttatgagcctaatttgcaggagcctcatccattgtaacatcacctccgtagtcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgaggtgggcagctgtggagtccttgtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccactttaaaaaagtct

SEQ ID NO: 339336 - DNA, 1671 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagcactcgatccacagtcaagagtaccacttttcacgatatctctaggatatggacatcttcctccttctctgcacatcaaaacttacctgtccattgtcctatgcttctggggtgctgcactctactttataaagggtatcccatcgtcctgtgtaagccccgagtctgctgcaccgggtgataatgccagactgcttgggcgctgctgcacatcctcaccaaactcctgaactcctctctggaccacacatctcctgtgtgggctctgtctcccacactctgtttctggcacaaatctacgtctcttcaagaagaatatagttccgagttttccaggaaactcttaattgatgtctagtcaagatgacgtgggtacagaatgacagaatgggagtcagatgtttcttgatgctagtacatgcttgctggaaggcagttatgagcctaatttgcaggagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggaattggatctctctctgtctttcatggatggtagaaggattcatggctccatgcgctaaagtctaccaaagcattcctttatctgctgggacttaaagactctggcaagagatattgaactttctcaattacttgctatttttatgtagaacctcaacaatgtgcataatcaccaatgtaactcacactacaaagcagacatgcagagaggatataaagtctttattttttctgttgctgatctggtctttttccagatcaccacttgctgcaggaaaattcatcgaatgtccaatgagtctaaactgagtttgatctagtcatctcaactggccatttaggaa

SEQ ID NO: 339337 - DNA, 433 bp, Homo sapiens
ttaagcaggtggctggctgggctccacccacagagtttctgatgcaataggtctggggtagagcccgagaatttgcatttctggcaagtttccctgtaaccctgatgctgtggtttgtggactccactttgagaaccgctgcagtaaatctatcttaatgcatatacgtgtccctgcagtaactcttagagacacgtaggaaccaccattcaccaatcttagcacctcccaacatttacccagaaccatgtcccatttttatttggggcaatgggctgtcctcttcaatgtctgctcaggtaatacaggagcactgggggaaacttcatgggcgagggggcatttggatccctgttcattaaaaaaactgttgtctctcgtgtagagcggactacagggaggagtgtgaagattatacaagcagattttacaa

SEQ ID NO: 339338 - DNA, 458 bp, Homo sapiens
tgaactcctctctggaccacacatctcctgtgtgggctctgtctcccacactctgtttctggcacaaatctacgtctcttcaagaagcaagttccagggttgctcctctgcctgtgtgtgtctgtgtttgtgctagtgtctgtgtccgtcctcttgtcctttctctttatctttggtcattctagtggtttctttacctgccctccatagcccagaacctctaccttatattatacaaccatttgtctttctgttctcctggactcacataggctaacccctcttcctccagctgagaatggagtagctccctttgaaaaaccgtatttatattcctccaggaatatagttccgagttttccaggaaactcttaattgatgtctagtcaagatgacgtgggtacagaatgacagaatgggagtcagatgtttcttgatgctagtacatgcttgctgga

SEQ ID NO: 339339 - DNA, 464 bp, Homo sapiens
agcctcatccattgtaacatcacctccgtagtcaaggtatgtgatcaatatatgtgcgaaatgcattaacatgtagtaacttgaaatttggcaactcaggagaattgtgcccatccactgtagaagcaggattctttgaaatcgaaccacacttagttgagaggccatgtcgtggtcttgtaattgtcttgttctgtttttcatctagaaaatacagtaatggattcaactctcccttgtatctgaattctatttctgctttcagttttgtcacacgttggaacatactaagctcgatgatgctgaaacgtattcaggattccaaggcaattctaaaaaaaattagtatcttcctctaattttaggctttgtagatagaggaaagctcactctggaaaactgacggagggcgtggcttggattttctggacttttgttgttcaataaatatttgttaaatcaaa

SEQ ID NO: 339340 - DNA, 1144 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccactttaaaaaagtct

SEQ ID NO: 339341 - DNA, 1036 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccactttaaaaaagtct

SEQ ID NO: 339342 - DNA, 1422 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagcactcgatccacagtcaagagtaccacttttcacgatatctctaggatatggacatcttcctccttctctgcacatcaaaacttacctgtccattgtcctatgcttctggggtgctgcactctactttataaagggtatcccatcgtcctgtgtaagccccgagtctgctgcaccgggtgataatgccagactgcttgggcgctgctgcacatcctcaccaaactcctgaactcctctctggaccacacatctcctgtgtgggctctgtctcccacactctgtttctggcacaaatctacgtctcttcaagaagaatatagttccgagttttccaggaaactcttaattgatgtctagtcaagatgacgtgggtacagaatgacagaatgggagtcagatgtttcttgatgctagtacatgcttgctggaaggcagttatgagcctaatttgcaggagcctcatccattgtaacatcacctccgtagtcaaggtatgtgatcaatatatgtgcgaaatgcattaacatgtagtaacttgaaatttggcaactcaggagaattgtgcccatccactgtagaagcaggattctttgaaatcgaaccacacttagttgagaggccatgtcgtggtcttgtaattgtcttgttctgtttttcatctagaaaatacagtaatggattcaactctcccttgtatctgaattctatttctgctttcagttttgtcacacgttggaacatactaagctcgatgatgctgaaacgtattcaggattccaaggcaattctaaaaaaaattagtatcttcctctaattttaggctttgtagatagaggaaagctcactctggaaaactgacggagggcgtggcttggattttctggacttttgttgttcaataaatatttgttaaatcaaag

SEQ ID NO: 339343 - DNA, 437 bp, Homo sapiens
aacccctccaagaccaacaagcatgtcagagagccccacactgctagggaaaacaatggatacaatgaaatagaagccctaactcagtcattttgacagaactgagttttacggctaggaaaatctagttcaaaaactttgtgactcctttcaccatctcctctctccttttgtacgttttctttacactgtaagtgaagacaccatagctaaggaagaaaatcccacgcgagtgtgaatcagaacagattattcactgtgataaaaactcaggccaggcatggtggctcacatcccagcattttgagaggctgaggcagcaaggaagagcccagggtctgtgtcacagtgggtaccgcaaggctaaagaggccccatctcccatgggacccacagcaggctaaagaggccccatctcccaggggacctgcagctct

SEQ ID NO: 339344 - DNA, 685 bp, Homo sapiens
aaaaggtggaattttggagcatttgtggccttaggcaagtcactttgcgaattttcctgagcctcagcttccttgtctgtagaatgggaattgtaccctgcaagcctgtggggaagattagatagaagagggtttagcattttggactacataaaagataattttgttgttattttttacaaatgtgcttggcagttttattcacagtacccgatacttagaaacaactcagatatccatcattagctgaatatgtaaacaaaatgtagaaaatccatatactggatggagcattacccaccaataaaaaggaacaaatagtgaaacaaccctgccacttagcagtttattagttggctccaagttcaccctcccgtacttgctctgctttgactaaataacttctgaagtatgtatttcagctggtgaagagctggactctttcacctttgcagtgaacaacatgttgggctttgtcaatagagggcactagagggacattacagaggaaaggggcttcttagatttggtggacttttctttttttaagtttttaaatattatcatggtgtcttaacatgccaataatgttgacctacggaattggtataatctcaaaatcttaggtgtcagtgttaaatatatgtttcacttttacttcatcgtcaccccaagcaaaaaaaaa

SEQ ID NO: 339345 - DNA, 143 bp, Homo sapiens
ggcaatgaaggaaagaacttccctagaaggttgtaggggtccccagatctttgtggctcactgtcacgagtatttccaggtggatatttgagcagcagactgtcattgggaagcagggcctgggctctgggccgcattggaca

SEQ ID NO: 339346 - DNA, 836 bp, Homo sapiens
agatggggtttcgccgtgttggccaggctggtctcgaacgcctgtcttcaggtgatccacccacctcagcctcccagagtgctgggattacaggcgtgagccaccgcacccagccaaaacagcttttttaaaagcagtgaggatagtagcaagtagagtgaatgcccaataagtcccttcctttcacgggcgataaccatgaagacacattggtgccgtttgtcacattactgtttctctgatgggactcattgtgaatgtgccatttgctgctgctttgagctttgcatttgtgaaacaggctgtgacaaagggtcccttagatagggattctagttgtgcttgaccacggtcagtcatgtgagcatcagtgagtctggtttccattgtagcagagcagcaggctttgcctccttctggacctgcttggcactgcacactgccaccaacagtggggccagtgctggaactgtgtggcagagcccagacactgtgtgttgacacgtgaggtctcccccgcttggtgacgaaatccttaacttgttaagaagttgtgcacctagtgggttactcaggagttctaaaacggttctgtgccctactttatgccacccagaccagaatagttctaggaggcaaagtgagtaatatttgggtaaagagaggttacaaccagatgggaggatgaagctgggcctccgtggtgactcaggagtgaagtgaaagtggctaaatcattgtctgagccttcgggaacgttgttttgctagagccattctgctggcacaggagcgcgtgttcctctgaatgtagtgggggaaaatgcggaatcagat

SEQ ID NO: 339347 - DNA, 217 bp, Homo sapiens
tgaatactttttaacttctatattacagttatgatttcaaggtttgtacttccttaatgtaaatctagggaaattgaaaaataaagcaccccacttccagtttctacatttataccacatctgttatcttacttatagatataatatccaactccttgaggttattatgtttataatgaactggtttatgttttcattccagatgtgtaaatagtag

SEQ ID NO: 339348 - DNA, 489 bp, Homo sapiens
tctcttctagttattttgaaatatataatgtattgttgttaactacagtcactcctgtatgctatcaaacactagaacttatttcgtctaattgtatgtctatatccattaaccagcctgtcttcgtatcttcctggaacccttcccatacacccttcccagcctctagtaactacctttcttctttttatttatttttttgacatgacatcttgctatgttgcccagactggaatcaatctcctggactcaagcaatcctcctgcctcagcctcccatgtagctgagactacaggggtgcatcacgactcctggctaaagacgaactttttttagttcccacatcagtaagaacatgtgatatttgtctttctaggcctggcttatttcatttaacataatgatctcaattctatccatgtggctgcaaatgacagaatttcattttcataaaaaatatggtagaatataattccattgtgtatatat

SEQ ID NO: 339349 - DNA, 463 bp, Homo sapiens
tgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgt

SEQ ID NO: 339350 - DNA, 395 bp, Homo sapiens
tttatttctcacaacatgtgtgtgaggtggcattgctcttattttatagataggaaaatatgctcaccaaagtcaaataccattctcaaagtcatctagttaatacttgtcgattacatgtattctgcaaaatctttaaggaaaattccatctcaaatggtaaaaacaaagcagaaggtttattatctcacatgacaaaacactcaaaggctcattcattcagcagctcagtggcatcatcagaatttaggttctttccaactttctgctctgtcaagcttgtaagctttgttttgctcaagggtgcaagatggctgcaggagttccaggcattgcatgcgtaagaagaaggccgtgtctttgtgcgtgtatatgtgcatgtgtatgtttcctgt

SEQ ID NO: 339351 - DNA, 415 bp, Homo sapiens
tcactaaaatttttacctccaatattaagataaaaaatcaccggcgtaggccggcatcttattttatagataggaaaatatgctcaccaaagtcaaataccattctcaaagtcatctagttaatacttgtcgattacatgtattctgcaaaatctttaaggaaaattccatctcaaatggtaaaaacaaagcagaaggtttattatctcacatgacaaaacactcaaaggctcattcattcagcagctcagtggcatcatcagaatttaggttctttccaactttctgctctgtcaagcttgtaagctttgttttgctcaagggtgcaagatggctgcaggagttccaggcattgcatgcgtaagaagaaggccgtgtctttgtgcgtgtatatgtgcatgtgtatgtttcctgt

SEQ ID NO: 339352 - DNA, 215 bp, Homo sapiens
cctctcttgccctgttccctattattagaaagttttatctagtcataaatcaactacctacagttccttataagattgatttatatttctaaatcaaaatgaaacaataattgctactatcctctcagttccagaaaaccacatatgctgtcctcaaaccccaaaccacaaatgctaaaaattatgaataagaggaatgtctatttgcttacatt

SEQ ID NO: 339353 - DNA, 309 bp, Homo sapiens
taaatcgcctaaaatcacacaactaggaaaagagatggctccacagccaggacacaaaaccaaacagactctggcttccgagtcttctcctgaacactgagcaaactacttctcaagacaactgagaggtcatctttgtgggtcctcacttctcagaagaggtcaccaaaatacaaggcactaaaactggcatttgattaattcttaagttactaggctaaaatattaactcagttatcagcaggtacgcaagagtattacatccattcacccagacagaacaaagatcactggcttcatgaaatttat

SEQ ID NO: 339354 - DNA, 341 bp, Homo sapiens
caggtgcagtgactcacgcttataattctagcactttgggaggctgaggcgggcgatcacgaggtcaggagttcaagaccagcctggccaacacagtgaaaccctgtctctactaaaaatacgaaaattagctgggcgtggtggcaggtgcctgtaatcccagctactcaggaggctgaggcaggagaaatcgcttgaacccgggagctagaggtttcagtgagctgagattgcgccactgcgctccagcctgggtgatagagctagactccatctcaaaaaaggaattttttaacaagcaagtgctcatgacattacaataataaattgtcctctagtta

SEQ ID NO: 339355 - DNA, 96 bp, Homo sapiens
agaaactgggaggatggggctttgggagtccatggcggaattcagcaagtgaatagtgctaggccttagagacagacatacctgaatatcaattcc

SEQ ID NO: 339356 - DNA, 384 bp, Homo sapiens
caatttattcacataaacttctctttactgagagtgcctgctgtggctctgcaaagtaagttattttaaaaattaacttcaaaattgaaagattttagggaaaaacttttgaacctagattcttagatatttgccacaaagcttaagactttgatctccaagtcctctcctgcagaataaactttctatatttaaatatcatctttcaacttagtcacatttcatttgtttattcagagtaccagctatatgctaagccccattcaaagatcttaggctatagatgcaaataaaacaaaaaccctgcccttagaaagattacattgtagtgaattaagacaatcaatcatcaaataaacaagtaagtatgtattacataaaatg

SEQ ID NO: 339357 - DNA, 200 bp, Homo sapiens
gatatatgcaagtggcagatctggagggcagttctctcaaaagtatccgtttgcgtctactctggggtccacacaactgatttggaaacagctcagtaggtcctggtccaggcaaaccttttcttcaatatcttggataatgatagtgatgccgggcctgccaaagggagatgggaactgggtgatagggtgccagctat

SEQ ID NO: 339358 - DNA, 297 bp, Homo sapiens
tatgagaagcttattatttttgaacgtctgcagcagggccaagccttagtttgtgtgcatcttcatttcctcctcaagagatttaaaaaaaaccccagttagacctcctgaagtccccttccaggcacctgcatctccttcctcatggttatgtgttaatggccttgatccagagctgcaaggcagccctgcaggtgtaggcacctgccaaacagatgagcactcacacgtggtgcaaacaagcacaagtcctttagcccgatgcccatccagccatttaaacacacaccagtgcct

SEQ ID NO: 339359 - DNA, 452 bp, Homo sapiens
gtttaatctatacatttatatattaagtatatgattatgtatggcttgcaatgttgactgacttgtggagtggcttcagcctgtgtgcccgaggctctgcctcctgagtgaacaggaagtactaaggagaattgtctttttgggaactccatgtggctagtggtgtttatgattgaaattgcatcaataaaagtctgactttgtggaaagacacaaacgtgcggggacctggttatataatgaatttgccattccgcttgaaattccagtcataaatgaaattcagagaacacttctgttaggagtaccacctaacctgcagttctcctacatgaatgctctctcggcatgcagagccatgcaagatatactagacgcgtaattatcaggtacccataaggtaacatttatggcaaaacctgaaaaacataccaagagaaaggggataggaa

SEQ ID NO: 339360 - DNA, 1100 bp, Homo sapiens
aacatgtaagactactgttcacaatttggacattttcctttcaaacacatttttcatgaatatattataggaaagttaaaaccatctctattctaaaaggaaaatctaccatttggctcagagagaaagttactgagtttgtctatgtgattttaagtagtatttgattagagtattaaagaaatggggtacttcaagtaacataacacctgatatttaaatctaagttttaaaaatgtatttcacccattgttaatgaaagtgtttctaagatgtaacccctggttagctattccgtcttcttgccttgatgggttgactggtggtgaatgtgctgttgtcattccattgacagttcgggattttgtggtggtctcagcatattagcatagatgtgagttgtaattttataggattatggaactgtaattgtggaactcctgcagggcagactctggaggctagctttttagaaaactaaaacctccagtataaacttaatttctgtcatttgccccattttcttgaaagttaagtgccagaaaagaaaaggatcgagtctctcttttctttctacaataaaacagaatatactttctccagggtttggtggtgggttcctttttcctgttgaggtggattctgagattgaggaggggctggagaagacagagcatgagggaaagagactgagaacatactcaggctgccctcgcctccttttccctttcgtgctcctgtctcccatctaggaggaccagggctaccagtccttgtggggacaagtttgagtaggatcaagagacatgtaactgcgccaggcgcggtggcttacacctgtaatcctggcactttgggaggctgaggcaggtgaatcacttgaggtcaggatttggagaccagcctggccaacatggtgaaaccctgcctctactaaaagaatacaaaaattagccaggtgtggtggcaggtgcctgtaatcccagctactcgagaggctgaggtaggagaattgattgagcctgggaggcggaggttgcagtgagccgagatggagccactgcactccagcctggtgacagagcaagaactctgtctca

SEQ ID NO: 339361 - DNA, 295 bp, Homo sapiens
ctgtgttatgctctgagtctaaactttgtctaaattatcttttgcacatagttctatgaataggaacttgaaacagggccttcctgatacatatattgctctctatgaagaaacaaaatttcatgggatcagctacatgagaatatgcactatctattttaactccttttttttgttgaaattctttgttgtcccttaaagatattttgtttgttatcacattaaattttctctgttgtttcacttccttaaattacacttaccaaagtggttattacaaatgttcaatatgttt

SEQ ID NO: 339362 - DNA, 760 bp, Homo sapiens
gggtatgtcggcaggatttggaagtgctcaagcaggtggtgggagagcttgctttgatgctcccaaagaaagtgttgcccaggttctctcctgcttgtaattagacctgtgttccaccccagactttggctgcagctgcgtgaccctggacaattcactgtgaatgttgcagccgtggtaacctcatccataagaacactgggaccccatgggattgtgtgtggacacagtgagatgaaagcttgcaggcaccaaccattgctctgaaatgggagccagtgatgggatcagaggttgttaattatactagtaatcaactgagccctggttctcaaagcctgttccctggatcagcagcagcacctgctaaattctgatggcgtttgatagaaatgcaaattctcagccccacttcccccaaagtccttgattgaatttattaatctgccgggtgtgatggctcacgcctgtaatcccagcactttgggaggccgaggcggatggatcacctgaggttaggagttcaagactaacctggctaatgtggtgaaacccccgtctctactaaaaatacaaaaattagctgggcgtggtggcacctgttatacaaaaattagctgggcgtggtggcgggccctgtaatctcagctacttaggaggctgaggcaggagaatcgcttgaaccagggaggctaaagttgcagtgagccgagatcatgccattgcactccagcctaggcaataagagtgaaactctgtc

SEQ ID NO: 339363 - DNA, 243 bp, Homo sapiens
aaatctgcgttcaagtacttgaaagacaacaaggataacttattcctaagagcccacagtccttcccacatcgtcgccatcaccatcactctccccattttctgatttcatttctcaaatatcacctgggaagtttttacctcctttttctttattttaatgattagtatgaaagattaatttttcctcattgccaagggcatgatattggagaacaggtaaatagatttatctgatgcttta

SEQ ID NO: 339364 - DNA, 180 bp, Homo sapiens
aacctttgtgagtcagccatgcccgcaaagcgtgctgtgttttagtcctggtaggaatatttatcagagttcacactatataaaacccaacagcttcaactattgccctttcaacagttttgccactgaccggataaaaacggtttcagtctttggatggatgtgtttgtggtttgtaac

SEQ ID NO: 339365 - DNA, 504 bp, Homo sapiens
aacacacaataggtttggtagaaattatgtgaaatgagataacaaagaattttacaatggctgttctgcacattttaaattccaaatatctcacagtaggccagacactttgggattacaggcgtgagccaccgcacccggccaatctgtataaagcttttaaaagattcctcagagtctggattttagtccaactctttgtttcccaactgatatatctgcctctacgctcaagccaaactcaattcccacacaccctgtgctctcttggcctctgaacttttttgctcatgctgttaactctacctaaaatgtccagtctaaaatcctcaccatcccccagccctttcctccacaaaggaatccctgactccccactccccacacttcttatacccactcccatacctcccttatggcatgtaggcctgtaccattttctacctcataccagtatcttgctcctcaaaaacaccattaggtcttgagcgctttgtccataac

SEQ ID NO: 339366 - DNA, 363 bp, Homo sapiens
tttcatttcctttgggactatgccctgaagtaggattgctgggtcatatggtagctctatttgtactttctttaggaatccataccattttccactatttccaccaatgacactagtctacattcccaccaacagcatgcaagggtcccttttctccacacccttgccaacacttgttacctgttgtctttttgataatagccatcccaacaaatgtgagcccacccttccttttaactgtcattttaaatatagcccagtggctgggtgcagtggttcacgcctataatcccagcactttgggaggctgaggcgggcagatcacctgaggttaagagttcaagactagcctggccaatatgg

SEQ ID NO: 339367 - DNA, 511 bp, Homo sapiens
ctccctacaaagaaaattcctgctaagccaatgagtgaggtgagaaaattggaacctcagttgcccagtcctttctctgcaatatgcataagccgtggctgcctcagagagccccagtctgccccacctctctcaaggtgcaggagctccccccacacccgcagtgatgcctcctggtactggcctagcacctaagcacaagccagtgcagggctgattgtcaccatcattcactgggatcaagcattgcctcaccacccctcaacctcaccctccactaaaggaatttacctataacacacaaaggcagaaatgccagcactgtgctgcccacattggcttttttcccctccaaacagcctatctatatatcagatgtgctacaaaagcctggaggatgggaagtttttcatctttttttttttttttttttttttgggaaagggggggggaggaacgaaggggatccctaaaaagccacccggagggtttccaagttgggcagggcccg

SEQ ID NO: 339368 - DNA, 650 bp, Homo sapiens
ggtatacaggaaatggataatactgtaacaatctgcagctgtctcatatgttatataaagaatgaactcataacagtgagaaaagggtatgtagtgcctttatgaatactaaaaaaataggtcaaattcctggaatatgtatgacttggttttattataattatgaaaccctttaacctattattcttttaaatacaagcagaaatacaagacattgccattaccagttagctttaatagactcaagaaacaaaatagtctcttaagttttatgtaagtgataaaataaactaagagttcctcatagatataatacttgaaaaatggtttctagttagtgacggtggaataaaatcattttcttactctcttctcttgaatgccaatgaaaagaaaatcaaacaaaagatagaaaatgtcaatttcaaagacacaaacaatcaaacaaaacttcaaacttgagattatgaagcatgcatgccagttgctgtagataagtcaaaatgaagaaggaaccagagagatgacaccttagatcattaggaagaagtaaattgctcttaaaaccaattgtaagaatttgcacaagctatctaaggattctttgattacagctgagatctacagattaggacaggccagggaatgtt

SEQ ID NO: 339369 - DNA, 559 bp, Homo sapiens
tttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaac

SEQ ID NO: 339370 - DNA, 262 bp, Homo sapiens
catggcaggctaaggggtggtggtggggagtcatcggaacccctcaaatggtaatcatactccatggcttctgtctgtatccagagtgatggtggcggatgtatcactctggttccaagagcaactagagagcttgtcatctgtgctgagatgcactcacttctgcaggttttgttctctccctgggccatcactcctcagaaagggtggaagaactctggaaaattttcacctatggtctcttcaaatactagttttctgc

SEQ ID NO: 339371 - DNA, 357 bp, Homo sapiens
tcaattttgccccaatttacatatggaaatatttaacacgttcaaagggtcacatagacatcaacattttggttttcatgggcaaaaccgtaatgacaaaggacaataagaactaatgcaggccagtgcagtggctcacgcctgtaatcccaaccctttgggaggccgaggcaggcagatcacttgaggtcaggagtttgagaccagcccggccaacacggtgaaatcccctctctaccaaaaatacaaaaattagccaggcctgatggtgcatgccggtaatcacagctacttgggaggctgaagcaagagaattgcttgaacccgggaggtggaggttgcagcaagctgagacca

SEQ ID NO: 339372 - DNA, 118 bp, Homo sapiens
aaaggtggaatcctagcccatgcttttggacctggatctggcattggaggggatgcacatttcgatgaggacgaattctggactacacattcaggaggtgggcaaaacaaacaaacaa

SEQ ID NO: 339373 - DNA, 669 bp, Homo sapiens
aaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggagg

SEQ ID NO: 339374 - DNA, 242 bp, Homo sapiens
gacaacaaaaacaaacaaaagacttaattgtctcattctattctaatattttaatgaccttttactacaagccaccaaatatacttttgggccatagatgtaacatgaagtttaaattaagctgccttaataaacaacacaagctaattaagattgcttgagaacactaagatttttacaactgagcaacaactttagaatcagattctaaagctagcagatatcatcttctatgcacatgt

SEQ ID NO: 339375 - DNA, 411 bp, Homo sapiens
acacacacacactcactcacacactccttcttgactggataagctaaagtgaaaaagagattatgttttccatagcagaaaagctgacaccaaattcagcaagcagattaattatgcatgtgaattgcaatctcccagataatttgctttccttctttttctggttgcactttctagagggaagtgaattaatggaacaattaccttgtatttaaataataccctgcattttgtttcctcagtctggtagtagtcactaaaatttatccaagctatgtatccaaatgtgtgaagtaaaaggatacacaaatgttatttgtataaaatttgcatattttccctattcagcattccttaggcaaagtttaaaattagaagtggatctttattaacctcaggtgcaactttttt

SEQ ID NO: 339376 - DNA, 956 bp, Homo sapiens
aggctgaaagaatgagagttgtgaccaactcagtataccactggaggctatatgagcaaacagaaaactgttcttatgaaagcaggatgttggaaaactgataactgtgtctgccgccagaaggggtgctgagggcagtcaggcctcatgcacagtgttccttgtgattatctataggaacatctgaagcctgttgtacaaagaaagcaattatgtggacctgtgataaatcaagcagtggaccaaccattagctctccctccctgctctttctacctaacaaatatgaaagactgtagaaactcagggctgcctttgctctctagaagcaaggagcccctgaccccctctttcaaaataggtcttttcgtctttgtctttacttctgcattcgacccccttcattgaccctgtagaaactgtcagtgacattctcttttcccttgtattttctaaattttctataatttgcatgttattttaataattagtgagggcatcaaagaagtggatttacaatggtgcaaacattggcagtttcagttaggaactcatattcctgttgggtcagagattgagccctggaggaaacctctggtctgagggctacagggaagctcctgtttcatgcctattcctgaaattaggcctgtccctctgatttagggaagatttattcctctgtttgtctgcatactacagaaacagctgtgaaagaatctgcaggcatcacttacaatgtaacttagcatattggaaatttctgttgaggacatcaatggctttcatgtcctctggagtctactcaacaatttttcttcaaagtctaaaggagattttttcttccagcataatattccgtgcagtgcagaaagtcttttcttttgccttttggtaaatggcctaagagattttacagtttattgagagaattcctatgccattatcattaagtt

SEQ ID NO: 339377 - DNA, 299 bp, Homo sapiens
ctgtgacttatcaaaatattagaatctctcaagaggctaattgcccccaggttcttcttgcttatgcattatcttgtggatgacataataaaatcaccacctcatttaccattcagttaaggtttaattgagtccatctttttcccccctcaaaatatgcaggaacttagagaatcaaaacaaattttcatctgtaaaataagaggatcttcataaattgcctctttataagttaggtcctatttataaaattcttgaagttaaaacctgagctagcataataaacatttttccttgat

SEQ ID NO: 339378 - DNA, 126 bp, Homo sapiens
ctgttagaaatattttataagccatttcacactagaaaacaaacattttttcatcagtatccctgatcaaattaaattaattccaaactatatttagaatattaaggcaaatacatgatcaagttt

SEQ ID NO: 339379 - DNA, 226 bp, Homo sapiens
caatataggagatgttactgccaacagataattatttagctttgaaataaatggtttgaaaacttgcttttataaaatatttgaagaaatatcaacttctttattcttagtaaggaaaaaattcattctaaattttcacattgagagagggactgctgattatagttggtgtgaatgggcttacagcttaaaacatttagacatcgaattgattttaagtgtttta

SEQ ID NO: 339380 - DNA, 468 bp, Homo sapiens
tgtttctctgtgtccccatagaactctggatgctcctgcataacccagctaatccaaaaggtcctttggaggtaggactctgtgcctgtctctgaatcccttttatttagcacaggacaggtggtagatggaatgtttgctaaacgaatgattcaacagaggtaagaataagaatgtcatgttccagctgggcatgatggctcacgcctgtaatcctggcagtttgggaggccaaggcaggcagatcatttgagggcacgagttcgagatgacccgtctggccaacatggtgaaaccccgtctccgctaaaaatacaaaaattagctgggtatgatggcacacacctgtaatcccagctactcgggaggctgaggcacaataatcgcttgaaaccgggaggcagagattgcagtgagccaagattgtgccattgcactccagcctgagtcacagagtgagacgctgtc

SEQ ID NO: 339381 - DNA, 178 bp, Homo sapiens
tgcctcccccaaatagttaattttatattttttgtactttgtttaaaaagagtgataaatttaggaaaataccacctgtatgcattttccttaatcttatttactaagaccttatgtactttttatttttgagatagggtctcactctgtcactcaggctggaatgcaatgacatgat

SEQ ID NO: 339382 - DNA, 1005 bp, Homo sapiens
attaatttgtgtggttccttaattaaaggctatgtcctgcactaggtagtaaactctctgagtatagggattgtaatactttcctgtgactgctgtaactgagcctttaaaaggccatttcaccgttctgtcaagccagccgcttcaggacgatggggaacgtgggaagaccagatagttccacggcccatcgctgtgctgtagttgcagttgttcgctgtcaggtggcgagtgcagatatgaaccatctggaagccaggacccagtgtgttttcttcctcgttcggctggtcctagggaactccttacgaggcataggcatcagcaggggccacactcacttggaagctctgggtgaacatctgtttccttgcctttccagcatctagggctacattccctgcattccttggctcacagcaccttcctctatcttcagtgctagtgtgtagcatcttctctctgactccgcttccccctgctgctgtcacgtggccttctgctcttctgtctggaatctccctctgcctctctcttagaatgacactgaggatggcgtttagggcccacccagatcatccagaatgatctccccacctcaagatccttaacttcatcacatctgcagtataagataacatctttttttggcatataagatagcattcacaggttccaggggctaggacctgggtatcttttggaggaccacgatgctgcccatcacagggattatgtgttttctttgtagcctcacaagctagtacagcacctgggactgggtaagccagtgacatagcgaatgaatcaataaatagtgttgtattagtctgttctcatgctgctaataaagatataccccaggccaggcacagtgactcatgcctgtaatcccagccctttgggaggttgatgcaggcagatcacttgaggtcaggcattcgagaccagcctggccaacatggtgaatgccgtctctactatacaaatacaaaaattagccag

SEQ ID NO: 339383 - DNA, 130 bp, Homo sapiens
tagacgtcttagctcctgaagtacaactttaatgctatatgaattttgtcattttgctaacactggtgtgctgcggtcatccaccatcccactggagttatttattccattcatattaattcttgttaca

SEQ ID NO: 339384 - DNA, 447 bp, Homo sapiens
tgtatgagccgtaagaatgacttggagctcttaaccctctcactcctacaacacagctgctgggtctcagatgtccctgcaggatcacactgcttcggtcccatcaatgccatgcagcccccactgcccagggaacacagcacagttaccatagttcttagtgggcatgagctccatttccttagctaagcctcagtcctcctgtctaagcctcagtctaacctgtttgctgattccactgcataatcccgacacctggcaatgtgcagggtataacctggcactcgatgtatacctcgctgctgccgcgatgccctcttgcagggagatcctgcctggagcatggtcctggccagctgggcaccaggtgcctgccctcctgccacacttttagttagcacagcgaccctttccagggcgggcaagttcccaatttgaagctatgga

SEQ ID NO: 339385 - DNA, 856 bp, Homo sapiens
ggtgacacgcaaggattccagccttcatgagttaaaagcaatttttgtctattttgtagcattacaaaattaaatttcagtctttactatttttcaatatacagtttttttattcagctcattaacagtaaggttctacttacaggattaaagcaaatttaaacttattgttgaatatgaaaagttgtaatcaacatatattatggtgttatttaaaataaatattataatgtactttcaatagggagaataatttttatttagaatcacttatttatatcatactgtcctaaaaataacaaaataatcgttgaaaaattttaagcagtctaacaagattgtgtattgctgtgaaaaagagctgggaaaatgtcctgccgctttaatttacaaagcatgccatgctcctgccacctagtggtaagctttaagagcagtggtttgttgaacaagtacttaagcttgtgacctgttttaagttacaggttgcatttacttgttgacagtgctgtctgttgccttatggaggtgttgcctaggagtctggagcattcatgctgcttctcctaccagctcacaaggagaaaccccctctttagtgagtggaaactcaggcagcagagtcagtggttcaggtagtgctaaatatgccatggaaaaaactcttaaatgatgacaaccaattggacccctctccagggagctatggtaagctgcagtctcttggcacatgtttctagttgagttgggaccctggctctattattaaaagatccctggcaaccggggcaaactgttgaacttctcctgccgtgggtcttctcaagggtaggatatggagtaacttcatctgccc

SEQ ID NO: 339386 - DNA, 217 bp, Homo sapiens
gaggctgaggcagaacgatcgcttgagcccaggacacagaggctgcagtgagttgactgccccactgcattccagcctgggtgacacagtgagaacctgtcaaaacaacagacaaaacaaaaacacaaactcatgactcaacctatgctagcttcaaacttttcatctgaggcttcctcatcactctcagccttcacagaactgaagagttaaagct

SEQ ID NO: 339387 - DNA, 295 bp, Homo sapiens
aagagattgtgtcagaacagggttccaataatgaacttcataagaggttttagataacctaagacattttgaaatataacacaactacaggaaattatacaatacaaatatgtagcttgattaattattataagataaacacctttgttgactcctgatatggcctagctgtgtctttacccaaatctcatcttgaattgtagttctcataatccccacttgtcatgggagggacccagtgggagataactgaatcatggagttggttaccctcgtgctgttcttgtgatagcga

SEQ ID NO: 339388 - DNA, 249 bp, Homo sapiens
atggcaataataatccctttcctgccttcttcaccaggaaaccatgaggacggggtgtaaagggactgtgtaaaatgtgaaatgtagtgaacactaaaaggtgtgtttggactaaggagcacccctgacctagggctcagacctgtacagccacctctgtacagaggtgagggctccctctcctctctcacctggggctaggttcgggaggtggacaacactgagtggcattgagagcatcaacccact

SEQ ID NO: 339389 - DNA, 428 bp, Homo sapiens
ccaccgcacccagcctacctggctactttttaatgttctttcaagtaatggatgaaataattccttaacacagagatcctcaacctttttagcaccagggaccggtttcctggaagacagtttttccatggactgggggcatggttttgggatggaactgttccaccttggatcatcaggcattagttagattctcataaggagtgtgtaacctagattgctcacatgctgagttcacagtaaggttcacgttcctatgagaatctaatgccaccgctgatctgacaggagacggagctttgtaagcttgattgccactcacctcctgctgtgcggcctggttactaacaggccacggactatactggtctgcagcctggggtttggggacctttgccttagcctactgttacaatagtagttggagc

SEQ ID NO: 339390 - DNA, 799 bp, Homo sapiens
tctcacagtggcatctgatggggtttcgggaataattgccgaggtcagatgtgggttagtgcaacctgtgcttctcatgggagggtggagactgagaggcagaagtgatgatatagagggttagaatcacttaattttacttacagaaaaacctaggctcaaagtgttgaagccatttgtgcaggagtgagtttgtagcagagctagaactggagcccggatttcctttgctgctatattttccctttagaaatgcccatttcagaactgaaatagaaatactgtccataggcttctctttcacctacagagaagaaaagcagatttcctccttctgccctggacactagttcatcatctgtcggaagcagtcataaacaagcacacatttactatgcatacaatgtaccgttatgacaaaggaggaccaaaatccaaacaatatcaaaccacaccaaaaaccacaaggagcctaataattactaaggtgatacttccaaagggaggactttatttcttagatgagaatgaaaatggacacattggaaattattggagagccctctggctatgagtccttccacaaccatatggtaccaccgactggcaggagaaatgtgtgaacatgtgcctcctcctcccccaaccactggggtcggtggggtgacggtggcacttttagcagtatcctccgtggtttgagttgaaaataagttttaaaaatcctgtgagtcatggttttgcattgaaacctcttcccactgtgtacccacaaatagttaactaaatagaccattag

SEQ ID NO: 339391 - DNA, 709 bp, Homo sapiens
tggaaagcgttttcttctgctattctgatggaaaactacttctcatgctctcattaatgttatatttgcaatggagtcatgttggcctctaccccagcacactctgatgctgggctggtgataagaggcttgtgagcctgaaattggatgctgaccttgtgggacattgataggacagagatgacatggcaagtaccagcatcacgtctcagaaaatagctcccagaggtttggagggagtttactacaagaagataatggtccttgcctcggatatcttctgtgtgagagatactggaaatggaatgcttgactgataactgaagaagggagaaagtcctatgggagtggcccccaaatatctctagaagagtctccacaaggttgcccttcatttaggcgagaaatgaatcttttctcttatttgggtgagagcacagggattcttataactcgtctgtcctcatggctgggacagagccagggcgtagaagatgtcattgaaccctgctctggtcaggcctagctgttttcacattagaccatttctgggcttttggtgtctgtatcaaaaatcattatgttctggctgggcgcggtagctcacgcctgtaatctagcactttgggaggccgaggtgggcagatcacatgaggccaggagttcaagaccagcctggccaacatggtgaaaccctgtctctgctaaa

SEQ ID NO: 339392 - DNA, 473 bp, Homo sapiens
gggaatagactgtgcagatatctgggggaagagcatcttggcagagggaaaagcatgtctaaggtcccgagttaagagcaagtgttgtacctttcaggagcagtgagaatctccttgtggcttcactggagtgaatgaggaagagagaaagaggaaatgaaataaaaccagaacagtagaagggggctgaatcacttagggcctggtagatcactgtgagaatttgcattctaggcttttattctagataagaagggaagccattgaaggttttttgtttctttttttaaacatgactaccattgtcacacctaactaagttagcagtgattccttaatatcacctaattctcagtctgtatttagatctctccagttatctccaaggtatcctttcacagatggtttattccatcaggatcaataagttgcatttgtctttttgtcacttttattttatgtcagctcccccc

SEQ ID NO: 339393 - DNA, 289 bp, Homo sapiens
aaaataaatagggttttgtgtgcaaggaccttaaatttaggttaggggtatgagcagccaaggagcgggggtgtcgggcaagcacagagtcttctttttaagaaatccattcaagagctctaaattgctgtttctgtttcaattatgtgacaatttcaagggtttagaaaaatctaataaaatggtcttgatgatgcattctggggagagagtgcttcagaagatctaggagaataaattccttgggggtcaagagattctcgttcctgccaccttgggccttccttca

SEQ ID NO: 339394 - DNA, 516 bp, Homo sapiens
tgtagtggctagtgtctcatttctgtgcttaggaaagggtgtcagaataacagagactgatgataaaggaaaaagtgtttcttttttttctatttctcaaatgtataaaaaaggaagtagttgattttcagtaaaaaagttgcccactttacaatctgagaaatatattaacaacaaaaattatttttttaaaaagatggatatttgggttcaaaattaatttaaattttttttttttttgaaacggagtctcactctgttgcccagactggagtgcagtggtgtgatcttggctcattgtaacctcctccgtctcccaggctcaagcggttctcctgcctcagcctcctgagtagctgagattacaggcatacaccaccaagcctggctatattttgtatttttagtagagatggggtttccccatgttggccagggtgatcttgaactcctgacctcgagtgagccgcccgcctcagcctcccaaagtgctgggattacaggcgtgaaccaccg

SEQ ID NO: 339395 - DNA, 276 bp, Homo sapiens
aatataatgtagtttgtgtgatggtagcttgttagtttatgaatgttcaattccctatcagactttagcctaattgttttacattccagtagataatccctaccttaatcaataatttcattatgggccaggcaatgtggtttatgcttataattccagcacgttggaaggctgaggtgggacggttgcttgatgtcaggcattcaagaccagcctgggcaacatagcaagagcctgtctcaaaaaaaaaataatacattaaccaagcatgttggc

SEQ ID NO: 339396 - DNA, 262 bp, Homo sapiens
gctcctgactggctctggggtagcccccctaagtccagggccaggaccccaaacttgcatcttcaggagccatctgtgggtctcccgggaggcaccagagaagccacacttcccacagggctgctcctcccggggggcgccctgttcacgtcagctctgccatcgtccccccattgcccatttaagaagcagtggcgcctgtaatcccagcactttgggaggccaaggtgggtggatcacaaggtcaagagatcgacaccat

SEQ ID NO: 339397 - DNA, 464 bp, Homo sapiens
tcacccacttccaccaacgtcaaaagtttgatactactgtagtacctactcaaattaaataatcttgtcatctgaatcaggttcagccatggtgtagacacttcaggtctagttccataaatacatatccttgaatataatccctcttcgtctgaaaactggtagatactggtttcccaaatacacaacagataataatgatacagatagagggtaactgctttaaacatttctgttcagaaaggggggaatggcaggtacaaaaaagccactggcctataacaattctgaagtccaattatgcaattactggaagttacttaataaggtcaaaagactttgtataattctccatggctcttggctttaactgctggggtctggttctgccctctgagtcatcattcagttgagcagctctctcagtctactccctatcagcataattctgagagcccaaacgg

SEQ ID NO: 339398 - DNA, 509 bp, Homo sapiens
ttctgtgcccaatgtggctgaagagcaggtcagaggagaaacccactgtgggcagagaaggctgttcatgggggagataggtggcagccttcttaagagccagaactgtatctctaatgttgcctcctctgcaaatgaggccaaaagaaatgtaaagttatattaatttgcattttccagattttagagaggctataaaatttgccttgtaaagagagactggctttcagaaaactgtttggcacccagcatctggtaatgcacgttactctgagctgcccagtgaaggggtttgaggcaactggacttaactgtacctaaaggccccaaaacctgagtgggcctgagacagcctcaggagtttgctggcttccaatgcactgtgggaacagacagactcctcttttagaaaaataaagatggaatttttttcccctctttcggttgcagcttatttcaaaggtcatcaaagtaaacaaaaggaaaagactgtggggcattaaaagtca

SEQ ID NO: 339399 - DNA, 378 bp, Homo sapiens
agcaacaggaaaccaaggaagtgagttgacaggctgcttccagcatggggacaggaacgggctgggctgcagcggatcaagctcattgccaggtttcgggcctgtggagtttaggatacaaagcaaaaactgcaaagggcttcagagaactcaggagacgagactgtgcataccccagacggcctgcaggttgagtcattctttccctcccatccgagcttgctggatcctccactgattagattagaacagcggcttcttggcatggccctcgctagggttcatgggggctggtctgtccccaccctacaggagccaacagggaaagagcaagcccttgcctgctcctggggtcctacaccctgaagccacggtcaa

SEQ ID NO: 339400 - DNA, 407 bp, Homo sapiens
ctgaacactgaatgagttcagtgtcgcaatgtcaggagtgtggcaggggtcagattagccaggtgtttggctgtcaggctaaagagggtgggctttacgtgggcagccatcaaaaggttttaaactgagagtgacaaagttaaatctttggaaatccctttcaggctggaaggtgcacggataggaagggagactcctagggcaggtggtggccactgccgatagagaactgagtgggaaagacacactgaggctgaggccgctgcggatggcacgggcacagcaggccatcagtcatgtctgttagtgagcatccatggcctgtgggcctccagctcgacctctctaggcctaagcaggagagtagggctggggaatcatccaggaatggtggcagaaggaaagga

SEQ ID NO: 339401 - DNA, 630 bp, Homo sapiens
cccaggttcgcccccttggttcagtccccctaggtccatgcaggctacaagtggcacttgaacaggcaacagtccgaacacagggactatgaggacatgaacgaagaaggtctgccggagcagaggaactgaaattgaaaggcgaacagggatgccgggccgggtctgccagcagcggatataagtctgtaaaatcagatggactgccaattggagaatgagagctgcccagcctggccctacgttctttcaattaattcataaacagaaagggggatatgcagggagccgaaggcccgtaggattcggcattccactggaggctatgtgatcaaacagcaaactgtttatcatgaatgcagaatgtgggcaaactcacaactgctcctgccgacagaaggtttgctggaggcaatcactccctggcactgaggttatctactgcgacatctagagcctgttgttcgaggaatgcagtcttgcaagcctgctctggactgagcagctgaccccttcttccaccccccttctcactatctcttttgcctaataaatatggagggctgtgtaaagctcagggcccttgtctactagaagcaaagtgcccccagaccccttcttccaaataca

SEQ ID NO: 339402 - DNA, 591 bp, Homo sapiens
caaatatactcttttgtctcttgtcttttattcccaggttcgcccccttggttcagtccccctaggtccatgcaggctacaagtggcacttgaacaggcaacagtccgaacacagggactatgaggacatgaacgaagaaggtctgccggagcagaggaactgaaattgaaaggcgaacagggatgccgggccgggtctgccagcagcggatataaggtcagtgccctaaggaggtactgggagtagtgctttaaggaagtgctgggaaccggaagttttctgaatcaggctaacaaggggaagaatttgtctgttgaagacaaacattatgtgcagctgcttaaagttctgttgagacagtctggagctcaggttaattcgcaggcactaactaacctcctgcagaagccacaaaatgttactatgcataacccatggtttccccaggcaggcactcttgatgtggaaaattgggacagagcacgagaaggattaaaacgggctcatcaaaaaggtcttaaagttgattcttctgttttcttcacttggagttcagttcatactgtacttctgacattatcttcttctta

SEQ ID NO: 339403 - DNA, 625 bp, Homo sapiens
gggtacgatcatagctcactgcagtcaacttctcagactcaagcgatcctcccacctcagcctcccgagtagctggaactacagacgctgcaccatcacacttggctaatttttaaaattttatttttaatttttgtagagacggcggggttgggggggcgggtggcgggtcttgctatgttgcccaggctggtctcgaactcctggccccaagcccaaagcgatcctcctgcctgggcctcccaaagtgctggaattgcaggcatgagccactatacagcctaattcagggttttttttaaccagggtggggtaatgagcttgtgtaggaacaaaatgcacccctatttttctctatgtgaagtatagcatttcctttcctgattgctggagcagccttagcagtgcctgaaactgtgagggtgagtgtaaatgatagttccagataacagtttgtgcagggccaggcatggtggctcacacctgtaacctcagcgcttgggagtctgaggcgagaggatcacgtgaggtcaggagttcgagaccagcctggacaggatggcaaaaccccgtccctactgaaaatataaaaattggcctggagtagtggcgcgttcctgtaatc

SEQ ID NO: 339404 - DNA, 107 bp, Homo sapiens
tctagaacacagatgccacaaaagtgagactgttttattatcccatgggtccttgatgctctgttcctttttgtcagtttgtcttctctctgttgttcctgttgttg

SEQ ID NO: 339405 - DNA, 683 bp, Homo sapiens
aatcgcaggcaaccagcagaagctagaattttaggcaaggaaagatcttcccccagagccctcagagggaccatagctggccaacaccttgatttcagacttctagcattcagaactgtagagaaaacatttctgttgttgtgagcctcccagtttgtggtactctgttacagcagccttaggaaatgaatatagattcccagttagggtcccacttaagagctgaagctgtaggaggtacgcagtctccctggaagaagacccgtggggtggggggatccaagccagagttgggggagaaagagccatgtgtgagaaacaagatgaaaaaccaggctggacactggacaagggatcaggaaacagcaatgagcccttggtttgaggagagcagggaggaaggagagggtggtgagatgggaagcagtgtcgtgaagtcaatgcaggagaattttgaacagagatgaggtagcaaatggagacagatgctcccaaaatatagaataagaaatgagagaaattcctaagaggcaggtgatcaatgcacatttcataccaccatattccaaagaaaagaaacttcgaatgccaaaaaggtcaagtgaccccctctatatccattagacaggtgttagggctaagatacattatgtgaaaaactaagctccaagacgatatagaga

SEQ ID NO: 339406 - DNA, 303 bp, Homo sapiens
gatgactctctcacactcattgatctattccagtgtgtaatccgcgtagactcctacagtcagagcattgcaagcgtgagtgactggtccctggcgtaggccttgcatcttctctcttttaaaataggccagaaataaaactaccccttatctcatcataaaattattattttgcagctaaagatatgtaatggcttcatgctggcctaagacacagactgagagtgtaactaatggatcatttccttcccgggtgagaattatcatcccctgaacatcattaacataaaatcccatgcaata

SEQ ID NO: 339407 - DNA, 303 bp, Homo sapiens
ccgactctttaggatcccctgatctcccatctctatattctaagaaggtaattatataattttataactgaaatgtctaaattttataaccaaaggtcagatccattaaaatggaccatcatttatgcaactgcacctgttgaaggcattacatcacattttctgccaacttacttaattcttgctcagcaattactggtttctcagtttctcgcctgacaataaaatacagaaatcttccattctttattaacctacaggcaattttcctttgtggtttaagaagtctgacatactcgctat

SEQ ID NO: 339408 - DNA, 163 bp, Homo sapiens
ctacctattcatctatctatacatccatctatccatctatctatctatccatctatctatcatctacctacctacctacctctctaatctaatctatctctatctaattatctatctaattatttagagacaggttctgctatattgcccagggtggtctcaa

SEQ ID NO: 339409 - DNA, 233 bp, Homo sapiens
atggggaaactgaggcccggaggagccgaggaggttgctgaaggtcacacagccggtgagacgcagctgtgcacttggggctaggtctgtgtgcccccggggctgtgctcaccctgcctgtagttgcctctcccctcaaggggcttccagtctagtcagggaggcagagcaggtacgtcaggccaggcggtcatgccgggaggccggagaccagcccgtgggagaggagttta

SEQ ID NO: 339410 - DNA, 353 bp, Homo sapiens
acagactcatagaaacagagaaatacaataagagagagaaaaggcaaggagacagagttaaagggacaaatggcagagagaaacagatccagagagatggagacacagaaacagagaacacagaagcccaaaagtcagacagacgaaaacagagacagattgagcaacaggagacacatggaaaaataagatgcacaaaggcagataaaggaagaggaagaagaaaaaagaaaaccggagagaaaaggcagaaacagggagaagtaggttcctatatcaagctgcaggaactgtgggagcactaggtgataggggatcattccgggggtccccggctgggtctgattgagtgg

SEQ ID NO: 339411 - DNA, 581 bp, Homo sapiens
atacttgatatgcctaggtgcgacattttggagtagctacctgtcaccaccatgaactaaatccatcaaaggcaatgggcacttcttttcatgttatggatttcattaccagaacaattgttattacctgtttatctttggcaataaatggtttgttgttattatatagtccattattttatatgtgttaaagacatgattttatgacaggcttataatttgtatgcgtttgaatctatgctcaggtctttttggtcagtctgtacattgcatgtatatacatacacacacatataaatttttaaaattacaaaagtaactcaaagttacttttggaaaaatttcaaacaataaaaattatatttccctcatgtctgttgctcaccccattccccattccagtccctagagttaactatttttattcagtttgaatattttttgagaccttttacaatatatctgtaactttatacacataaacacatgtactcacagacatacccctacatactttttaaagaaaagagatacttagaacaattaaaaaattgacaattggctgggtgtggtggctcatg

SEQ ID NO: 339412 - DNA, 165 bp, Homo sapiens
acagatactgcttgcattaagcaaagacctcataaataagaatgtaataaaatgggccatagtgacttaattttcactgccattcttggtttgattatcaagccaatccaaacagggacaaagaattagatgagtatattggctgactgggttggatattaaaaa

SEQ ID NO: 339413 - DNA, 1133 bp, Homo sapiens
ttggaaccccctctatcatcatatgctctcagatccacacacccttctgtactgcactgaacactatcagcaccggtcctttatgtttatgtccagactccactaaatagtgggaatggtagggcctttctctaccatcccacccagctcctaaaacactgctcaggttcatatctagatttcgaaatacacaaccttctgttaacatccactaacactagccgagatcttgccattgcactccagcttgggcaacaagaacgaaactctgtctcaaaaatgaaagaaagtctgccttcctaacttgcttccaggtgtcatctgtgttgttgatccttggaccacagctagagtgccaaggtaataatagatgggcttcaataggtaggcaggggccagatcacatgggatcttgtcgccatgttatagacagttactggattttgagcaaagcagcagttttcattagtgtttgaagaagtttactccttctcttggttgggaaaaaaagatgctagaggggagctggaagaccagtttgaaaaccacagtagtagttgcaagataggtcgtgctggcctggacttggctagtgttagtggatgttaacagaaggttgtgtatttcgaaatctagatatgaacctgagcagtgtttttggagctgggtgggatggtagagaaaggccctaccattcccactatttagtggagtctggacataaacataaaggaccggtgctgatagtgttcagtgcagtacagaagggtgtgtggatctgagagcatatgatgatggagggggttcccaaacgagtctgagaggttagtggaggcttccctggtgtggggactgatgctcaaattaaaacctgaaacctgagtgggagtgaaccaggcagaggtagctcctgtagaacttctgatgatgtgaaaagagagaagagtcaaggatgtgtcctactgttcagagctcctgggtgctgcctcttactcagaggaacaaggctcaggggagttgacaggaggggaagtcaagggttacgtttcatgttcagccatgacatatttgagccaaacaagggaagatttttcagcaggccactggacctgggagtctggagcttgcaaggg

SEQ ID NO: 339414 - DNA, 325 bp, Homo sapiens
agaggcagaagaggtgagaatgagagaaagggatgtgattacagaaacagggtcagaaagatgctatgtggctggctttgaagatggagccaagaatagattttgaatgtgggtaacttctagatgttggaaaaagcaaggaaattatattctctcctagagactgcagaaggaacacagccttgccaacaccttgattatagcctggtgagactcaggctggattttttttttttttttttttttgggaaacaaatttttcctcgggggcccggggtgggaggtgcgggggttacaacccccgggcccagggacaaccccgcgc

SEQ ID NO: 339415 - DNA, 262 bp, Homo sapiens
ctctaatgagagcatttacgaagattgccaaacaacaatcagaacaagaattacatgggactgaactgatggagaactaaaacgattttcatggggctgaactgatggaaggttacagtgatttttatgacttctgtttgaaacattgctgattctatttatattttgttttccaaagtgaagaatgcttcttttcttttgagctatttttatcttacaacaattggataaagtttacttttgtgaacaaaattaaaacatt

SEQ ID NO: 339416 - DNA, 216 bp, Homo sapiens
gaggctactgcagccatccaggtgagagctgtcagcagctaggctacaggcgtgacagtggagcaggggagagtgggcagagttgagatctgttttttagagctaggatccagaatgaatgaatgaatgaatgaatgagcccctgagggataaaatttaggctcgagttcctgtaatgccactgagtttcagtgtgaccctgggcagatcccttcc

SEQ ID NO: 339417 - DNA, 90 bp, Homo sapiens
agtccctgctctcatggaacttaaatcctcatggggtctggcagttaactgaaataaaaggtaacatatgtacggtatttgaaggttgta

SEQ ID NO: 339418 - DNA, 96 bp, Homo sapiens
acacaagtcagaatatgacattaaaatccagtgaattgcactgatattttctcttacagacaaacctagtctgtaggaaaataaattactctttct

SEQ ID NO: 339419 - DNA, 234 bp, Homo sapiens
gatatatcaagttaagggcttgattctttccttctacttaaccagttttcaagagtgagttaaaaaatatagggctttcaacaacaaattcagtgttcctaatcagagattacataaagtatctatctagaagatgatctatttctatctaaatgatttctacagggaaggttgagtcaagtgaaacataatttcactttgaaataagaatactaatcagaatccagtaaaaca

SEQ ID NO: 339420 - DNA, 544 bp, Homo sapiens
aggacagcaggctggatggacccttctgaactaaggaagtggggaagagtttaccctgcaggtagagaatttcatgctcttcccacaatacccttcctcttttccttcttccagttgcgttagcaacttggcactccacagtcctttgctcaccgccccctgccttcccagtgcctacttctgttctcagtctctgtggtctctgattttgagtatttttccagaccctatatagcaaatcccatgtcttcccagatttagcatttcccactgaccttttaggttttggttcctcaattctggctaaatctgatttttctgtaaatttgatcctgtttgctgtatctcttccagaaattcctcaaaatttcttattgattgatggcatccgttcctgttttctggctttttaatgggtttattcttatttttatattccttttgtcattcccttggaacttggagtgacacaagaatcaaacacttgagctcagcccgtcaccattgtggactcagtgtatctcattacttttcactttgggct

SEQ ID NO: 339421 - DNA, 144 bp, Homo sapiens
attaacagcctggtgtctctccttctgtatgtttcttcatgctcaatcatgtgcaaatacctcttgtcatatttttggttgtttatttttacagaaaatggtattgtgtcatattcatacttagcttgcttccacatcaataga

SEQ ID NO: 339422 - DNA, 234 bp, Homo sapiens
gggtccaatggtaccgctcggtgataggcaatggcctcaccacttggcgataggcgatggtctcaccatttggtgatagtctcacctcttggcgacaggtgacagtcccatctggcttgccaaaatatgcccaaaattgtgagttcttgggtctgacttcaagaatgaagccgcagacccttgtggtgagtgttacagttcttaaagatggtgtgtctggagcttgttccttct

SEQ ID NO: 339423 - DNA, 168 bp, Homo sapiens
tccatctgcctggacattcacccaccatgtcaggaaaataaaaacctaggtagcaactgtacagattctaagtcaaaaaagatagagcaaattgcataccctctctaggaaaagcaaaccactgactttctgaggtcttttgtttaagcccaaagataattacaagag

SEQ ID NO: 339424 - DNA, 462 bp, Homo sapiens
ctcagccccacataaggagtacttccctgctaaggtttccattcatcacaccaaaatcactacttaaacagcttctgctaatacaagattcaatttactgttataaaaagatctaatctgcaacaacatccgtatgactgtcaaaccccaataagcaaggtgacctctctgcttggtgattcaaacttgggccaaaatgaattgaaaagctgagacaaacagggacagttttctattcagtttcacagctgcttgggctactgcccagtctccataatgagggtggtctcttgctttgttttcatgaaaccaacagcatgtagaacacacagcatttcaataacgtatgaatttcagccttcaggatatcatattgtccccagttgcttgatattttgtctctctcctcctcagaatagtcagaaacacactggagcacacacatagtaatactatgactat

SEQ ID NO: 339425 - DNA, 945 bp, Homo sapiens
aggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacagattttatccagaaacattttattagagatcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttagg

SEQ ID NO: 339426 - DNA, 618 bp, Homo sapiens
agcggcatcctttttttgtaacttgaaggcacagatgtaaggagcctctgctttgcccccactacctgacttattgtagacgtctttcttacataatcatgcatcacttaacaacagggatacattctttgagaaatgtgaagttaggccaaaacatcattgtgcaaacttcagactatactcacacaaaccttgatgatatagcctattgctcctaggctacaaacctgtacaggatgttactgtactgaatactgttaccatttgtaagaaaatggtatttgtgtatctaaacacagaaagagtacagtaaaaacacagtacaaaagattttaggctgggtgctgtggctcacaccctcacgcccgtaatcacagcactttaggaggcctaggagggtggatcacaaggtcaggagttcgagaccagcctggccaatatggtgaaacccccgtctctactaaaaatacaaaaaattagccgggcatggtggcggatgcctgtagtcccagctacttgggaggctgaggcagaggagaatcgcttgaacccgggaggcagaggttgcggtgagtcgagatgcaccactgcactccagcctgggtgacagagcgagac

SEQ ID NO: 339427 - DNA, 286 bp, Homo sapiens
gacaaactctgtgacattggcatttgactctccctgcatgtgctgtgactgtaaatgccaaagtctcaggtagatatacagacacccccgttcaacggtccctttttagtgggactaccccagcgcttcccacctgcccatatatctgtgccgctcccagcaccacactctatggctcctagtgccctaggtagaaaatccacattcttcctgcccttgggatttgaggctccagaaggaaagtgtctctgacgatgctgttgctgcctggaacagccactttgcc

SEQ ID NO: 339428 - DNA, 921 bp, Homo sapiens
cctggtaactaactgaaatataatactgctttcaacaaatggtcgtcttttaaaactaaattatcattttattatgtctttattatttttcctgtttacgaacataacctgtactcatttggaaagttctaaatattctggaagtatacattatgaaatttcccccacaaactcaccctctaggggtaagtgtataatttccaaaactctttactcatgtttgagattttttttgacttatctggttaggtctagctgggttaggtctacctgggacctaacccagggtgagatgtgtgaacagaaagtagtacatttacagaaaggccactgcagctgcatcatagttctataactcttcaaagtccccaggcaccctaagtagatagcttgaagcttcacctttacaaagtccaatccattgcatcaaaagcctacattatcccatttcctgtggcctagagattacaaatcacctgaagtagataccaaaacccagtgagtaaagacggaagtaaatctagtgagtttccaaccacccaccgcccccgagatcttaaaggaagcagtaacaagcaactagaactcacatgagaatttataggccaagagattttaatgtaagtgggaccaaaggaggataagtgagaggataagcagtgtgggttaagagaaagaggatagtggcaaatatcaagttgagatgggtagagaatcattgtgtgaggttactctatctacaccaatgtggcaggaacaaatacaagtgcataaaggtacattaaggaaagttgaaaggtaaatagataacagactaggaaggcgaataatattccacaagttcttgcaagctttattctatccttctctcttaaagaataaaattcatcaacttagagacaaagggagacaccggggatc

SEQ ID NO: 339429 - DNA, 715 bp, Homo sapiens
cctggtaactaactgaaatataatactgctttcaacaaatggtcgtcttttaaaactaaattatcattttattatgtctttattatttttcctgtttacgaacataacctgtactcatttggaaagttctaaatattctggaagtatacattatgaaatttcccccacaaactcaccctctaggggtaagtgtataatttccaaaactctttactcatgtttgagattttttttgacttatctggttaggtctagctgggttaggtctacctgggacctaacccagggtgagatgtgtgaacagaaagtagtacatttacagaaaggccactgcagctgcatcatagttctataactcttcaaagtccccaggcaccctaagtagatagcttgaagcttcacctttacaaagtccaatccattgcatcaaaagcctacattatcccatttcctgtggcctagagattacaaatcacctgaagtagataccaaaacccagtgagtaaagacggaagtaaatctagtgagtttccaaccacccaccgcccccgagatcttaaaggaagcagtaacaagcaactagaactcacatgagaatttataggccaagagattttaatgtaagcattcttataattaaatacctcttacaaaaaatgccatttaatcagacaaggggaaaaaagtagcatcaaaagagatgctgacaaggaga

SEQ ID NO: 339430 - DNA, 296 bp, Homo sapiens
ccaaaacttaacaaccaaagatccaaacttctttcaccagcagctttcctgagtagagaaacagtaattgtcagcctcataaccattaggctaaatattatgatgttaggtgtaagcagttttcaatttcagcaggcaacttttttgttcagaataattttctcaaaagttttgagctattttttctttttaaaaataaatatcagcaactaaactgtctaaactgatctcatatcatttgctgtttaatattacagcagaatttttattgtgtataaatgttatttaaaatgtac

SEQ ID NO: 339431 - DNA, 343 bp, Homo sapiens
ctccaatgactggcatattcctagttctattactaaaagaaagaaagcaggatgggtatttgtgcacttagactctgccacacatcccatctccaccacgtcctgctctctgacatagccttcatgcgtgcagatcagggcagaaattccccagacatccatcctaggctaccctggcagccaatgtgactatttccctgaaggcccttctcccatctactgcaagtcacctaccatggagtttgcctactcttctgtgatatagttttgtttactcaaaatggaaaagacatgtcctgacttagtgtgatgtctcctttagcctgtacctaatgtcctggcc

SEQ ID NO: 339432 - DNA, 433 bp, Homo sapiens
tgtggagtctggtagttttggcccatgaccataccttaaagtttcatcacctatcctctgggaccatttctttccttaatatatttaaatcaccaaagtagcttggcacaaaacaggtgaggcctgtctgaaatatgctgaagcccgtgctgctttgtattaactcattaaaacaaggaacctggatcacctgcacctgatctgcattctagtctggctttagaaacacattagacttaaattcaaacgcaccagaaatgaaaataattgatatataattgtttttgtatagtgaagtagaactttctgagtttttgaaatttccttgtttctcaattattcaggcattattcatgcattttattatagcgtaagttaaactgaaataggcagttagatactccattctgtaactctgaacacaatgggtttg

SEQ ID NO: 339433 - DNA, 633 bp, Homo sapiens
acgtcactgactctttgggcaggagactttcatttcttcccctcacagtctctgtctttttgggttttctatatcttgcctcagtgtcgccttagggcttcggatatctttgctagattctgactgcacagttcagtgagaccttgtataagatgtgcttagagggttcagatgaaagtagttgattgtgaattattccagctcaagaactgaagtggtggtgcagagcttcctaaagtaatttctgttgggtctgaaatgccttgtgcattttataaaaagatttgtcttcctaattctgttttacttaaattaataaagatgtatataatctcggagaatgtctaagttggaaggtgacagatttgtggcagggaggagctggctgagcattaagatgaactcttaagtaatgcacatggggatagttgagctgatgttattacagattgagctgtggccacaggggatacctgtggggtacgcttgtccctcattgcacctgaaggcattctacaggatgtcactgttgctgagtgcagtgctatgatgagatcctggtcccagacagaaggaaagtgaataagtatgggcctttcccagctctgccaccatgtaaccggagaatgtccc

SEQ ID NO: 339434 - DNA, 434 bp, Homo sapiens
gtgagccactgtgcccggactacatttattttaattattttatgtagttctgttagaaagttggacatgcaggtatttgtactattgctgggaaaaggtgtaatttttttagatatcttagtaaaatatcttttaataattttttagtagcacttatgtacaaacctttataatgtttttttggcattgtgcttttttgtacttaacatttaaatgttctcatgagttctgagaaaatgccttaatttactgttgttttgctgtatcttttaaagtaacactgttccttctatttctctagatatctatgcatttatgtaggacctatcatcatagtgcctaggcactatgtttgatgtcaaccataagaggaaacttgccaagaaatcttggtttaatatctgtcacttaagacaacaattaatctgttttcc

SEQ ID NO: 339435 - DNA, 4758 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccagggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339436 - DNA, 4123 bp, Homo sapiens
tgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339437 - DNA, 3467 bp, Homo sapiens
attcagaggtatattttttaacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339438 - DNA, 4666 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctcttgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339439 - DNA, 4494 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagagagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctcttgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339440 - DNA, 4768 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccaacaaaaaaaaaaaaccccccacccttggagttgaagtttactttagag

SEQ ID NO: 339441 - DNA, 4899 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccaatttccagggactcttaaagctctctcccaagtataaaatattatgtactttcaaaatcttaagcattcacgttctttctgagaccaacgccaggatacaaacttactctcaacatagatgcttatgtgcttttgggcacacatagtcttagaacagtggtcaaacagcttcacagacc

SEQ ID NO: 339442 - DNA, 1331 bp, Homo sapiens
cagactttcaaatggaatgaggatatgcaggttaagtttctcctctcttatcattcatcttccaatcttcagttgagtgtaggttaatgggaggatgttggttgggtcttctggaaggagaagctttggactcagctggtacgaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339443 - DNA, 3308 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagatttccttaagtgggatatttgagttcatagatggtagacttttatagcctggccaacatggtgaaaccccatctctactaggagtacaaaaatgagctggcgtggtggcgagcgcctgtaatcccagctactcgggatgctaaggcaagaaaatcacttgaacctgggaggcggaggttgcagtgagccaagattgcgccattgcactccagcctgggtaacaaagtgagaccatctca

SEQ ID NO: 339444 - DNA, 1960 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttata

SEQ ID NO: 339445 - DNA, 422 bp, Homo sapiens
cttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcatt

SEQ ID NO: 339446 - DNA, 4720 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339447 - DNA, 5370 bp, Homo sapiens
  misc_feature (3796)..(3796): n is a, c, g, or t
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacntaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339448 - DNA, 2745 bp, Homo sapiens
agggatccggcttgttgacctcagctccctacgcagcagcagatctatagatccacgacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339449 - DNA, 4548 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagagagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339450 - DNA, 1665 bp, Homo sapiens
cacgaggtttgtctcgaggagcagcttctttaggagctgttgtgctggctgacttttcctgggataagctgtgcaggtagtgggcagcgacagtccagaagtgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 339451 - DNA, 4702 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgctactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctacaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactcagctccagttacaacagctccagttacaacagcttttttaacttctgcat

SEQ ID NO: 339452 - DNA, 2941 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgactta

SEQ ID NO: 339453 - DNA, 378 bp, Homo sapiens
tcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccaggaatgtgtgagggggaagggggaaggacaagaggtttcaccccctggttagtttggcctcgctaaggcagggagccgccctcacgcaatgagcttgctttcagttggtggatttttgttgttacaaaagtgataatagccccgtgtgggaaattcccccatgcaaatacatttcccctctttctcgcgtatttctctgctgttttctctgcacctcgccctt

SEQ ID NO: 339454 - DNA, 259 bp, Homo sapiens
acttgtctctcttgctcttatcatacactgaaggtattccatacatactccactgctccccagccccaaggctgcaggtgaatgtcaactcggaaggactcttgttgcagcagaggccttcaaggcaggtgttttttttttttttggaaggcctttttggagacagagtcttgctctatcatccagcctggagtgcagtggcgcaatctcggctctcagctcactgcaacctctgcctcctgggttcaagtgattctcc

SEQ ID NO: 339455 - DNA, 417 bp, Homo sapiens
ggcagtaagtccactggcagctaatatgtacgggtccgacccctacgttataattattgtatatgagtgtagagatgatgattcttcttctctgaatagctgtattgaagcagtcaccatttgacttggtggtatggttaaataatcttaattgtgcacaggggtaagcaacaactgctcaaaattttttttttcttttgagacagttttgctcttgtcacctaggctggagtgcagtggcgtgatctcggctcactgcaacctccacctcctgggttcaagcgattctcctgcctcagcctcccaagtagctgggattacaggcatctgccaccacacacagctaatttttgtagttttagtagagatgcggtttcaccatattggccaggctggtcttgaactcctgacctcagg

SEQ ID NO: 339456 - DNA, 1008 bp, Homo sapiens
tggccgggttaatactatttgcattctacacttcagtatcaagtttacataatattgctaaatttccgtgtttgctcagaagcagtttacagtactaaaaccaaccagccatataacataactacataacaataaacacaatcttttctctcatgttctttccccctatttgaactcctgtttttctccttttgatatcttccaagaaaaataacttttaaattcctctatcatcacagtgctatagagaaacaaaaccaattttttcccaactgatgctgtcatctaagatcagctgtcttacttgcccattcttattacacaagcaaatttagaagtcctataagtacctacattattaccttttgctaaaaaatgcatctctgttcttctttactgtctcagcaaacagcctcaccattcgtggcagatactcatagctgccctctaaaaatctgttactcctcccttctatggcagctgtccagctctgctacatttcccatcctcactgcagttaggtgtggccacatgaccaagtgctctccagtggaacataagcacgtgtgataagtgccatttctaggcctggctcattactctcctccctcctcttttctcacctctggcaccagcattggaaggcatgtgtagaagatgacagatcttccagtcttcttctctgaatagctgtattgaagcagtcaccatttgacttggtggtatggttaaataatcttaattgtgcacaggggtaagcaacaactgctcaaaattttttttttcttttgagacagttttgctcttgtcacctaggctggagtgcagtggcgtgatctcggctcactgcaacctccacctcctgggttcaagcgattctcctgcctcagcctcccaagtagctgggattacaggcatctgccaccacacacagctaatttttgtagttttagtagagatgcggtttcaccatattggccaggctggtcttgaactcctgacctcagg

SEQ ID NO: 339457 - DNA, 975 bp, Homo sapiens
ttttatttgctttgtagcactcagctattttaaattcctcaccctacatatgcattgcctaacttattaatactttcatataacataactacataacaataaacacaatcttttctctcatgttctttccccctatttgaactcctgtttttctccttttgatatcttccaagaaaaataacttttaaattcctctatcatcacagtgctatagagaaacaaaaccaattttttcccaactgatgctgtcatctaagatcagctgtcttacttgcccattcttattacacaagcaaatttagaagtcctataagtacctacattattaccttttgctaaaaaatgcatctctgttcttctttactgtctcagcaaacagcctcaccattcgtggcagatactcatagctgccctctaaaaatctgttactcctcccttctatggcagctgtccagctctgctacatttcccatcctcactgcagttaggtgtggccacatgaccaagtgctctccagtggaacataagcacgtgtgataagtgccatttctaggcctggctcattactctcctccctcctcttttctcacctctggcaccagcattggaaggcatgtgtagaagatgacagatcttccagtcttcttctctgaatagctgtattgaagcagtcaccatttgacttggtggtatggttaaataatcttaattgtgcacaggggtaagcaacaactgctcaaaattttttttttcttttgagacagttttgctcttgtcacctaggctggagtgcagtggcgtgatctcggctcactgcaacctccacctcctgggttcaagcgattctcctgcctcagcctcccaagtagctgggattacaggcatctgccaccacacacagctaatttttgtagttttagtagagatgcggtttcaccatattggccaggctggtcttgaactcctgacctcagg

SEQ ID NO: 339458 - DNA, 160 bp, Homo sapiens
cccccaaaaaaaattagctgagtctatcagatttcttctcttgggagttgagaccagaaaaaaataccatcagggtatttagctctgagaacttaaggtgaaatgagactatgagagcaagtctgagctgtgaagtaatgaggcagcagtggctatgagg

SEQ ID NO: 339459 - DNA, 1317 bp, Homo sapiens
cttgccggttccagcaaaacttcatggagcatgggggtggcagatggggtgcctggtcccagccactcctctcccaacttcccactagccatgtgggcaagctcacattagcaatgagctcaggcctgctttgctcatttaaggaaaagcagtgatcccattatcccaggggtgattctttgccccagacgcagctccttttttctaacttccttcagccctgctggcttctcctcagcagtagctaatgtgggatgatgatcagcagcagttgagctatttttaagtcaacaaactaccaatgctaagagttcctcagaaagccaggaaattcggagcctcagaagcaaatgctaaacatgattgatgggcatggaagggaatgttttggactgctgttcacaaaaggaatcccttgaatttaatcctaaaaatggccaagctagaagagtccttagaaaccatctagtctgctttttccctccctagaaaatttctacagatgagaaagtaaagtggatgatggtttagggctgaggcacttagctgatctagaggtggaagccaactcttcctgattcctatgtgaatgctctttccacaaagatcagtagaatgtttctggatttctttgtttcaatgagcttcgattatcacactttatttttcttagcatgggctccataaaactaaattattgtacaaaatctaaataagttaattaaacaagcaccagacacagagtaacttaaatgacatcagggtgctaaatctcagtttatagtcagtggacagataactctgaaatatcagctggtggcatatccaaatcagtaaggaaggaccatttggtttttatgccacctgaacagtggcggcattccagctggtgagtcttcctggcctcttgatgcagtactccccttcagctgatgctttgctctctggggttaattcaatatccaggggcagggagccagacttggaaggtcctctccccacatctaactcctgcttcaacacccagctccaacgtcttctctgtgaagccttcctacatcttcccccattcctcagagtagcctaaatcctctcctaatgcccctctttataatacccctacagtcacactgtaaggttactgtgttaggcccccatcaggcctagggtgtgtgtgtgtgtgtgtgtgtgtgtgtgtgtgtgtgtgtgtgtgtgtgtgtcatgcctacagtgaatctctccagaaacaccaatgaacaggtttgactacaaggagactacaatgagaattttattgccaatataggagatttggga

SEQ ID NO: 339460 - DNA, 315 bp, Homo sapiens
cagtgatagtattgggaatagcttcagtgggtttctgatttttttttgaaagtctagacagacattaacaataatagaggcagtttcctctaggtagaggataatgctaatctaaagataatttctctttctctattctataaagatgaaaacacacatcaaaagatttcaacatgtgtgttagtcccagctgactcactctgtcttcactctctggacctgagttatcagaatattttaccacagtcctttcaaatgttgatgagttctcgagaagtttatttccaaatttgagtagtccttttatattccagc

SEQ ID NO: 339461 - DNA, 478 bp, Homo sapiens
ggggaaaattcgagctctttcaaagtgtgctggggttttttgctgaggatataatagtgcacaatatcaatatggtccttacaactacagaactatagaactaagattctagagggaatgacaggtggaaaaccaggaaacagacaaatgaataaacaactgctggctgtaatgagagccataaacgaagcactcaggactgagacaaaatcactattgaggggaacttgctttaagtagtggtcagccttagagcttgtttaaggagttgacattaagctgacacctaaaacctaaaggaagaaacagaggtagtgaaacaaagtctgagaaggtagcctggacagtttgcactaagccttgaggtgggatgtggcctgttggggaacctggcagaagaggttagttagcacagaggtagaaggggagtggtaattcgatttttactctaggctcaatggaaagccgttaaaggctt

SEQ ID NO: 339462 - DNA, 683 bp, Homo sapiens
gaaagtaacaccagccaagaactcactctcagcttttaactttccatgtatttacctcactctgtacccgttttactcatttatctcagaggaagtaatatttctctttcctacttgaagcagattccctcaagttcctaggtactttcaccatgttagccaggatggtctcgtgatccgcccgcctcggcctcccaaagtgctgagattacaggcgtgagccaccacgcccggccctggattgatctcttaatactaaaactgctggagaagaatcattacagccatctaggttattttcttctcagatttatggtcaacaaagataggatttcagggctaccaaagtatccttttatttgtccttagtcagctctgtcttccattctgcaaagcaaagattcttgttcaacttctatttcttttctcttaaatagaagatattgcttcattttctgcagggaaagtaacaccagccaagaactcactctcagcttttaactttccatgtatttacctcactctgtacccgttttactcatttatctcagaggaagtaatatttctctttcctacttgaagcagattccctcaagttcctaggtactttgacgtgtgtgtgttacctcttctgtattttcaactgcttccctctccactcactccttaccttcagcgctaac

SEQ ID NO: 339463 - DNA, 221 bp, Homo sapiens
gcagtggatcaatcacctacagggtccatttttaccacatctggccctaatgtgttcttgctctaaatctaatattgtttcctggcttttgtgactcaaattttctgttgctcacctgagttattctcctacctctactgactggtttccttgcattagctgcaattctctcaagattcagtctttaaacagctgtgcctctctaggctttccctcaggtc

SEQ ID NO: 339464 - DNA, 1504 bp, Homo sapiens
cgtgtcgcctctcgcctgctccacgggagcaagggctttctctcttattccactaggtcccagccaggcacgcagcagcccctcacacaagcatggcatgagtcagggaggaagggacagagggaatggccgtgtgaccttgggcagtaacttgggctggtttttcatgtacagaatgaggcgacgacccacttagattgctgaacacatcgagtggccatagccgtgagaagtgagagctgcccctgccctactgatggggagacaggtacaggtgacgggagcgttagccgagatgtccacccatccaccacacgcctatgggcacccttgtgccatgagggctcagcctgggccctggtggaagcaggtaccgggtcgatgctacctgcagcctcatcagagcctagctcttgggcagcgggcgtggttctggcctcttcacagccgaagtgcagacaggggctgtgggccaagctcctgaaatttccgccgacaagggcatctttcatgagtcttccttctgggccccctgttttgaaaccaaacaaggatgcagatttctgccaatcccgatgagctcggcatgagcacaggctctgttcccacgcggaggtgatgtcagccccgagcagagacaggcgcttggcattccacgagcctgggcggccgcgtcagggacagacacagtgtctgacagctggctttgagaaatactgacaccagttcacagactccattcctaccttcagggacccccagaaaggtgaaaggaccccaggttgtgtgaccagtcacctgatccagccccttcttgtcctggttctcccatcacagaggggccagggcagggcaggagtgggcctgagagcccatggctggtttccacatgcgccatgattaagctcctgcactcggcatttcagtaaagccatcttgtggtacagacagtgctgacatcagaaccttccgtggatccagcctcctacctccgggtacctgctgtgtgggagtcactcccctcccccagccctggatgctcctccagtcatcccagtagctcagggccagcccctgggatgtgtctaagaacatgagtggacaaatagatggactgcccagagcagggtttctgagacttcgctgcaggatatgtcatcgccctgcagaaaactacccccaccctaggaccccccgagttttggggtttgtaagaaattacatgtctcatttattttgaacaggtgaattttgcagtcaaattcttgtgttccattttagtacaaaaatagcattatcttttcaaaagtaacattttgaaattactcgtcaaataaattgatgcttcaggaagagctgtgtcaatcctgtaggtttatagatctgcgcttcacaggttaccccagcaggtccccggctgccgggcccaggtgatcctatatgaaactctcccctgctcagggccaggtgccttgctgggagcttgcaaagccttcactcccgc

SEQ ID NO: 339465 - DNA, 684 bp, Homo sapiens
ctggacttttcttcatgtgtcatgaagtttcctcctgattttcagagacccttccaggcctgcaagcgatttgacagccatccctcagtgccaactaaacctcctgggcagcctgaccccagggtaggaaggaagcgcctacaccaaggggccctctgggagctgagatcatcctggggttttgtcgcctggtctgacttgtgcactgggatcttctcgtgccaggccaggccccgccccctccccgggactgggcagaccccctccctcatgcatctgtgtccactgaggcttccctcacctagaatggcccatccttcaggacccagctcactctcatcttctttccagggacttatcccccaaggctgtcctctgttctggtgagctcagggctcttggaacttggtctgcagtgactctggggttcctggttaggacccatgttctctaggtcccagcaccctgcacggggcagtgtttgtgacactgggcccagctattctgagagaaggactccaaccttccatcaggtgtggcccgagatgtgggtggccctgggcatggggcatggatgcattgtgactttcatgggcctcttctgcaaaaaaaaaattaaaattatactttatgactattggtagaaagataaatatattaatacattaaaatttctctttgagt

SEQ ID NO: 339466 - DNA, 1884 bp, Homo sapiens
ctctggcccatggccagtggcagggttgtggtgccaactccactctgctgagagtgagcctagggtcttggtgtgtgagtggtgctgtggccacccggtgctcaggtcaccagggcggaggccttgccctcttgccagctagtttgctttactgggttttgctttggggaaggatcttctataaataccagtccatagagcacttcatcctgctttctgggacgtaagaactcatccctctaagaagagcctctgcaacagaaaccgaaacagtgcatctgcttaggaacaaagccactctctgtctggtgtggtcagagggtcccggatgtccccccctccactctgctgggcaggggctgtgcctgcggagcttccttccaggatctgtccttctcagcttccccagccgagccgccaggggtcctgaggaccaccatggcccctgaacactcctggagctttggtgtcagccctgccacccgagagagagagagagacatgccttggtgttacttactgcacttgagcctgtctcctggagggaaatgaagaatgaggcgacgacccacttagattgctgaacacatcgagtggccatagccgtgagaagtgagagctgcccctgccctactgatggggagacaggtacaggtgacgggagcgttagccgagatgtccacccatccaccacacgcctatgggcacccttgtgccatgagggctcagcctgggccctggtggaagcaggtaccgggtcgatgctacctgcagcctcatcagagcctagctcttgggcagcgggcgtggttctggcctcttcacagccgaagtgcagacaggggctgtgggccaagctcctgaaatttccgccgacaagggcatctttcatgagtcttccttctgggccccctgttttgaaaccaaacaaggatgcagatttctgccaatcccgatgagctcggcatgagcacaggctctgttcccacgcggaggtgatgtcagccccgagcagagacaggcgcttggcattccacgagcctgggcggccgcgtcagggacagacacagtgtctgacagctggctttgagaaatactgacaccagttcacagactccattcctaccttcagggacccccagaaaggtgaaaggaccccaggttgtgtgaccagtcacctgatccagccccttcttgtcctggttctcccatcacagaggggccagggcagggcaggagtgggcctgagagcccatggctggtttccacatgcgccatgattaagctcctgcactcggcatttcagtaaagccatcttgtggtacagacagtgctgacatcagaaccttccgtggatccagcctcctacctccgggtacctgctgtgtgggagtcactcccctcccccagccctggatgctcctccagtcatcccagtagctcagggccagcccctgggatgtgtctaagaacatgagtggacaaatagatggactgcccagagcagggtttctgagacttcgctgcaggatatgtcatcgccctgcagaaaactacccccaccctaggaccccccgagttttggggtttgtaagaaattacatgtctcatttattttgaacaggtgaattttgcagtcaaattcttgtgttccattttagtacaaaaatagcattatcttttcaaaagtaacattttgaaattactcgtcaaataaattgatgcttcaggaagagctgtgtcaatcctgtaggtttatagatctgcgcttcacaggttaccccagcaggtccccggctgccgggcccaggtgatcctatatgaaactctcccctgctcagggccaggtgccttgctgggagcttgcaaagccttcactcccgc

SEQ ID NO: 339467 - DNA, 1697 bp, Homo sapiens
ctctggcccatggccagtggcagggttgtggtgccaactccactctgctgagagtgagcctagggtcttggtgtgtgagtggtgctgtggccacccggtgctcaggtcaccagggcggaggccttgccctcttgccagctagtttgctttactgggttttgctttggggaaggatcttctataaataccagtccatagagcacttcatcctgctttctgggacgtaagaactcatccctctaagaagagcctctgcaacagaaaccgaaacagtgcatctgcttaggaacaaagccactctctgtctggtgtggtcagagggtcccggatgtccccccctccactctgctgggcaggggctgtgcctgcggagcttccttccaggatctgtccttctcagcttccccagccgagccgccaggggtcctgaggaccaccatggcccctgaacactcctggagctttggtgtcagccctgccacccgagagagagagagagacatggtgagtaactgaggcacagacaggttcaggcacagtcctggtcacaagtggccaccatgcaactctgggccccaggtctctcccagcacctgctctgccctaagcgtgtggggccgggcgctgcactgttgactttatgtcccctgtccccagccttggtgttacttactgcacttgagcctgtctcctggagggaaatgaaggtgagagggacactgtttcatctaagaggggaagctcgggaatgggtttgaggacttaaggggccaggagtcaaggtaaggaaagtgaatggcacagcgaggcgaagctgtgcagccctggtgggtcactgccaccgtccacgtccccaggtggcgtctgacacaaggtgggccaaagtggccctctccagcctgtctgcctcccatagcctccgtggggaaagcactgaggcaggatcagatggaaccagagaagcccatcccccacctcctgcccactcattccttaaagacatcagtctcggccgggcgcggtggctcaggcctgtaatcccagcactttcagaggccaaggcaggcagatcatgaggtcaggagatcgagaccatcctggctaacacggtgaaaccctgtctctactaaaaataaaaaaagttagccggatgtggtggtgggcacctgtagtcccagctactctggaggctgaggcaggagaatagcgtgaacctgggaggcggagcttgcagtgagccaagatagcaccactgcactccagagcctgggcgacagagcgagaccctgtctcaagaaaaaaaaaaaagacatcagtctctcccaaaacccagctaggttgctggcttgacggaggtcctggccctcagaaatcccgttgtcccaggacgggggcaggtggtctgagggcgccgcagcacccgtgagccatcctcactaggagttgtaccgtcctggtctggtcgtctcattctctcatgagctgggagctggcagcagagccaggagcggagctgcagagcaggctccccacgatgcccgtgtcgggatgttcctgccagtggcagtgggggcagccgggcctgtctggagcgactccaggctgctcagacatcaaagggaaaagcacccgattgtgttgtttgcggggctagttccttcttgtccctcaggtcttagcacagatgccccctctgg

SEQ ID NO: 339468 - DNA, 1143 bp, Homo sapiens
ctctggcccatggccagtggcagggttgtggtgccaactccactctgctgagagtgagcctagggtcttggtgtgtgagtggtgctgtggccacccggtgctcaggtcaccagggcggaggccttgccctcttgccagctagtttgctttactgggttttgctttggggaaggatcttctataaataccagtccatagagcacttcatcctgctttctgggacgtaagaactcatccctctaagaagagcctctgcaacagaaaccgaaacagtgcatctgcttaggaacaaagccactctctgtctggtgtggtcagagggtcccggatgtccccccctccactctgctgggcaggggctgtgcctgcggagcttccttccaggatctgtccttctcagcttccccagccgagccgccaggggtcctgaggaccaccatggcccctgaacactcctggagctttggtgtcagccctgccacccgagagagagagagagacatgagacccttccaggcctgcaagcgatttgacagccatccctcagtgccaactaaacctcctgggcagcctgaccccagggtaggaaggaagcgcctacaccaaggggccctctgggagctgagatcatcctggggttttgtcgcctggtctgacttgtgcactgggatcttctcgtgccaggccaggccccgccccctccccgggactgggcagaccccctccctcatgcatctgtgtccactgaggcttccctcacctagaatggcccatccttcaggacccagctcactctcatcttctttccagggacttatcccccaaggctgtcctctgttctggtgagctcagggctcttggaacttggtctgcagtgactctggggttcctggttaggacccatgttctctaggtcccagcaccctgcacggggcagtgtttgtgacactgggcccagctattctgagagaaggactccaaccttccatcaggtgtggcccgagatgtgggtggccctgggcatggggcatggatgcattgtgactttcatgggcctcttctgcaaaaaaaaaattaaaattatactttatgactattggtagaaagataaatatattaatacattaaaatttctctttgagt

SEQ ID NO: 339469 - DNA, 409 bp, Homo sapiens
gtaatagcagcccaagtagactcatacaatggtgaataccattctaagcactttagagacatcaactattctaatgtataactacgacgaagatattatcacctgtatattacaaacgagaagccaaaagcttagagaggccatatgccttaggggtgaaaagttgttcaagtaatacacaaaaaatatgagcaccagcagaaggagatcaggagttgcccagtgccaaggatgacagagattgaatgcaaaggggaacaaggaaagttttggggtggtggaaatattctgtatctcattttatatcttggtggtgtcacatgggtgtatatatttgtcaaaacttactgagctaggcagttaaaatggttatattttattgtatgtaatttatgacccaaagatgatt

SEQ ID NO: 339470 - DNA, 185 bp, Homo sapiens
ccttcaacaggtgtggtgtttacacaagcctctgaggagacaatcaggaatggaaagaagtcaggaatggaaagtccttcaaattccttgattctgagcaggtttcagctgttagctagcctttcccatggatgtttaaagctatctgtggccgggcgcgggggctcacacctgtaatcccagca

SEQ ID NO: 339471 - DNA, 334 bp, Homo sapiens
tagtattctgttttgtgatctggatgctgactactcagttgcgttcattctgtgaaagtccatcactctgtacaattataaattgtgcacttctctatatgttacacatcattaaaaagattatttttagaacatgtgaatagaaaaagatgaaactttagtctggaaagatgacaactccagggaatttatgagctcaaaatatataaaatcaggaaagttcactatctcttgtcatacattgtaccagtaggaaaataaaataataaaaagaaagacaaacagtgagagaaaacaataagataatacaaatcaatgtactctgcagggggag

SEQ ID NO: 339472 - DNA, 411 bp, Homo sapiens
ctcaagggaaaccgtgtagctgggtgttgtgataacagcaaggtaagggactggatggggttactttcttttttgatgccctttcctgaagtttccctctggcagaagcgtcacctttggctgacgtggaaataggaaattcaccctgtctccctcttctgttttcttcctaaggttcttgtctgtttagaataccattaagctgggcgtggtagctcacaccgtaatcctagcactttgggaggccaaggtgggaagatcgcatgagccaaggattttgagaccaacctagtgagatgccatctctgcaaataataataataataaaaactatccatggtggtgcatgcctgtggtcccagctacttgggaggttaaggtgggaggatcacttgagcccaagaggtcgag

SEQ ID NO: 339473 - DNA, 543 bp, Homo sapiens
ggtgtggtgggagagaaggctggatagatgatttgtggttatattttggagggtttttcacacacaagtgttcagactatattctcatggccaatggggaaccaaagcaggtgtttggtgtgagctgtgtttcgcaataatgttttgaaagatgtattagagaggcaggagtccaattacaaggatgtttcagaaattcaggtgagtgatgaagacatttggagaacagagtcagaggggattaaaaggagatagaagacagacaattcgaaactaggtgccaaagacaatgttcatgctattacttgagagagagaaaatacaggaggagaaggtatgggataaattggatattccagcaatggggtgggctaatgggtcttgtgaactcaaagattagtgcgagatctatccggcagttggaaattcagttctgaaagaaggaagctaacattttattgtgtacccactgtgtctcaggttttatgctaagcacctttgcaaattatttattgggagcagttttttttttttttttttttt

SEQ ID NO: 339474 - DNA, 189 bp, Homo sapiens
atataaaattacataagatgtacacacgcaccccccaaaaaccatatatttattaaagtacatccacaaggagactttaaaaaaaatacatctacaaccaaacatgtatttcttttttgttttgttttgttttttcaagacggaatctcgctctgtcgcccaggctgtagtgcagtggcacaatctcgg

SEQ ID NO: 339475 - DNA, 134 bp, Homo sapiens
ctgtttcttttcaattgtggagatcactttttgaaactgagtacaaaatgttaacatttatatcaattaaatttcattctgctttatacaattcaaaatggaatatacactggtggagctgggagggagaaaag

SEQ ID NO: 339476 - DNA, 360 bp, Homo sapiens
cttacttcctctacttagaaaggtttttgccttcttaatgactgccaaacattaccccttactcaaagccttctcagaatctccaggcacagcaaatccttccttcttttgcatttcagtaacaactgtatagacctctattagaacttcattatgacttttgtttacaaggtcagaagctgttaaattgagcacaaaatctgcagacaagccaacaagtaactggttaacttttgtttgccttgggtttagtttgctttactttttctatcgtctaaggtagaaagttaggtttttcagatcttcatttttagtgtaggtgtttacagctatacatttccctgtaagcactgctttaag

SEQ ID NO: 339477 - DNA, 183 bp, Homo sapiens
ccgagttttttctttctatcactgtttgattggaaataaacctaaattttaaaacagtcaaaagccacactatgatatttcttacatatagcttagcaaaaattgaaaagttcacggcactgttggagatgcagtggagaaagaggctctatcatacattactggtagatatacatctgttag

SEQ ID NO: 339478 - DNA, 476 bp, Homo sapiens
ccattgtggttgcaccatttacattcccaccaagagtgcacaagggttcttatttctccacattctcaccaacacttgtgatttactgtttcttttggtttttattttttattttttggataatagccatcctagtgagtataaggtgataactcattgtggttttgatttgcatttccctaatgattagtgacgttgagcatcttttcctgtgcgtgttggccacttgtatatcttctttggagaaatgtctattcaagtcatttgcccgttttttcactgagttatttgtgtttctttgttgttgagttgtagaaattctttatatattctggatattagcccctgatcaggtttatgatttgtgaatattttctcctgttccttaggttgccttttcactctgttgattatgttctttgatgaggctcctctcttttatcattctgaagttttgttggggcgagattgtattt

SEQ ID NO: 339479 - DNA, 701 bp, Homo sapiens
cctgggcgtgatggtaggcacctgtaatcccagatacttgggagcctgaggcaggagaatcacttgaacctgggagttggaggttgcagtgagccgagattgtgccattgcactccagcctggatgacaagagcaccactccgtttcaaaaataaataaaaaaataaaaataaaaatgttttccaggaggccaggtgtgaaggttcatacctgtaatcccagaactttgaaagccaaggtgggcagagcagtgagccaagattgcaccactgtacttcagcctgggtgacacagggaaactttgtctcaaaaaaaaaaaagtgtcgtgctatcactatgctttagaattgattgccacaatttgaataatattaatctaattctgattaaatacctttcaattaatatcttagagagttgtttagatttactgagcacaacctcattaatacatgtgaaaatgtgtctgaaattcattccttccggtgggttcttggtcttgctgactttcaagaatgaagccaccgaccctcccagtgagcgttacagttctgaaagatggtgcgtccacattttgatccttcagatgtgtccggagtttcttccttctggtgggttcgtggtcttgcggactgcaagagtaaagccgcagacctttgcagtgaatgttacagctcttaaaggtggtgcgtccagagttg

SEQ ID NO: 339480 - DNA, 518 bp, Homo sapiens
ttttcttatctgtcaattagggcagtttttccaaatggaaaaaaaaaattttagcacaatgtctggcacataataagcacttaataatgttagctaacaataataataataataatataatagcagcaaggaagtcacacaaccaaaagaagacggcactgtgtggtcagggccataccaaagtgcagacaaagttctctgagcgcttacagcagggtgtggtcacctcgggagaagtgtgtttgagccagcactgggagcccagaaaacatcttcactcagagatggtgcaggaggggcaacagacaagaagggctacagaggcctacgcagcagtaaaaggcttcccccccacccccacgagagcctctgtgcaggagggaaaggggacaaagataacagaacctttctctccagcttagcaagtggggtcaagggaagggcagggaaaaggagggagcgtcaggagaaaagacttctctgcgctctctgaagagcatgaagagggaggtgtgggt

SEQ ID NO: 339481 - DNA, 636 bp, Homo sapiens
attatttcccactgatagttttttaaaatgccaaatatcaatttctctaacctatatttctattttctcctgctcaaaattgttttaaaattagtttagattaagcatacaataaatattaaaaccaaaacaaattcaattttatgaatagactactcttcccttacatatcacgaccagctaagcaataaggcctacccgttatattttgtaaatataccttgaatctctgctttcctgtatctccacagcattcagtagttcagctcttcaatagctatttactgatatccttccctaatctatcccctatactactgttagagatactcctctacaatgtcaagtataactgtattaacttccctgtttaaaactctcaatagattcccatgacccacagaccaaactatttagaatggcatccaaaacccttcattgtttttctggacccacttacctctttgtatcttgtcactcccactatttacccattacactctagcaatattcaattctcttccatactcttattctttttacaatgagtgtattaatacataaagtatgcatatctttacatacatacttctggcctagaacgccttttcttgtacatcttcctgaagaacatga

SEQ ID NO: 339482 - DNA, 259 bp, Homo sapiens
tgcaggggctgtaataataataacaataataactaccagtgttagtgtatgccgactactctgtgctgagcactgtacgtggattcctttagggaagcctcacagcctccctgtaaagtggaatctgttgttagtcacatttcacagatgagagaactgaggctcagagaggagatgttacttacctaggtcatgtagttgttagggctctaagagctgggatttgaacctaggtctccccaacggtgaccggcgactt

SEQ ID NO: 339483 - DNA, 290 bp, Homo sapiens
gtcagctatgtcataattttcacaataggaaaataaccaatttctaactcaatttaaactaatttttaagtaaacaaaaatgggttagccataatatacataatgatactgtttatctccagattggccctatgtgctatctttgggctgatagttctttttctaaataaatttactaagaaatttattaatcaaatttcactttggccgggtgaaatggccagcaggaaggtagtaatcaacaactctcgaaggcccaaggagctgtggctcacgcctgtaatcccaac

SEQ ID NO: 339484 - DNA, 516 bp, Homo sapiens
tataaatgcatatttcttcttctcaactgatttaaaaaacaactgtataaaataatatgtataaaattatattttaggcctataacctgtagaagtatatttgataattatagcataaaggagatagatgggatcaaagttgtgttagaataagaaaatgataccagatcacaactcaaacctacaggaacaaatgagggaagccataagtggtaaattttgtataagaggggggctaggcgcagtgactcacacctgtaatcccagctctttgggaggccaaggtgggcagatcacttgatgtcaggagtttgagaccagcctgaccaacatggtgaaactccgtttctactaaaaatacaaaaattagtgtggtgtggtggcatatgcctgtgatcccagctactcaggaggctgaggcacaaaaattgtttgaattcaggaggcagaggctgcagtgagccaagatcatgccactgcacttcagcctgggcaacagagcaagcctctgtcttt

SEQ ID NO: 339485 - DNA, 373 bp, Homo sapiens
tgagagacagtctcactctgttgcccaggctggagtgcagtggcacaatctcagctcactgcaacctccacctcccaggtttaagcaattctcctgcctcagcctccagagtagctggaactacaagtgcccaccaccacggccggctaatttcttttgtattttagtagagaaggggttccaccatgttgtccaggctggtctcaaactcctgagctcaggcaatctgcccgcctcagcctcccaaagagctgggattacaggcatgagccactgtgcccagcacagtctgtcttttgaagcagctcaatccacccagctactaagctgatttgtggcaaagttgcagtttttacaagtttctatctctggc

SEQ ID NO: 339486 - DNA, 647 bp, Homo sapiens
ggagagcttggccatgtgacttgctttggctagaagaatgttggcagaaatgtcaatgtgccagctttgggcccaggtccctttcacttctgcattttcttgagaaaagcttcccttgcatatttgctgacctaagtacaatcagcaatgaggaataaagtccagctggacttgtggcttgaaacagagctgtccagctcaccccagcagagactggccaaccccaagacaacctgcaacagcaacatgataaatagaatgttcattgtggtatactgctgggactttggttgtatgttacatggtgccaatttaatgacagtaactgatacgtaatcacttcagactcaggatcgtcaatcttatgatagcccctaagtctgtctggcatcaacatacatttccctagtccatctgtctctatctgcaaatctttaacatgtactattccttcctcatttttggccgatgtcctttgcttataatttcactgagaaaaatgggaaaaactggaaaagaacatgtttcctcaaccactgtcctactggccagcatctgtgcctgtacactctgccatttcttccaaatgaactatctgttcatgctcctatcaaaagtgacttctccctttgagctttaaatcacat

SEQ ID NO: 339487 - DNA, 269 bp, Homo sapiens
cacctcttcttggtgtatctaatcattggaatcttccatttctgtctccttctgagcaaacggaggacatgggtgctggaattccttagttctggaatggcttatcaggacaccatcttctcatttgccaaaccatctgaacaactgattgatgggtgagataaaggacactctgaaaaggaattattccttcatgccagagtcctttctaaacctcatccattttcctttataaagagatcctttagatctctttataaatgtcatct

SEQ ID NO: 339488 - DNA, 755 bp, Homo sapiens
ggaacaatcacttgaataggtcatgtgcttatgagcctttttcctattttctggtttcctatatggcatttataaagcctttatcattggaatcctattaaaagtattcactcaaagtcagcagttggaacattttcaattccaagcagcatgtacaaggcaacgcaagacgaaagtgtctgcatgcgagtttccccttcgaagtagcatcacttcccccatgagcagatggcatcctctcaactcactgatgaactgcagcttcctcacaacaaaatgtgatagagaatgagacacaaggctctaggactgggagatagacatctaagaataaacagcaagcaaatgtaataaaaattggcattgaacagatctggaatggtaaacttttaaagtcagagttggagacaccattctttagagctttgggtcaaacaatggtctgtttaagaacaagttgaaaaaggtgagggtctatgattccaattacttctccaattttgctgacactgatgtgttcttagttggaattgattgatttcctgcatctcagtttctccagatgctcacaagtgatgccaatgtcaactcatgagatggggtaagaagggggtcgcttagcacttagaaagaggaccgagtacagagattgttcctctttaatctcaactggaaaagaaaagaacaaacctttaggccaggcacagtggctcatgtctataatcccagcactttgggaggccgaggcaggcaga

SEQ ID NO: 339489 - DNA, 496 bp, Homo sapiens
catatgaaaatgacagtaaccttgatcaggccaggccagcagagtgccgaaccttgatcaggccaggccagcagagtgccggctgccacaaagtgcagctcttgggccaccccttatggccctgtgttgcctgaggaccctccttggcatttttcaatgccaaggaccctccttggcatttttcagagtacgtgttagaagtttgtattttgcataggaaataactccttaagtatgcagacaaacagtgtgtttaagaataccctgacaattttttggcttcacattagtatctttaaagcctccattttcatgtttagttaaagagggaaaattgtaaatttgagttagatacacctagtgggtgtgaaagtttgcatatgatttaaagatataaagacttactaataatattatcagctgaatttgaggcatgaatgcaaatccagcctgactgggtattgactgccctttgtacaccggaataccttgtagt

SEQ ID NO: 339490 - DNA, 375 bp, Homo sapiens
gtgtgtgttgtgtagctgttggtttggataagaaatcatctttccatcatttatgaatgctgcgtgataactaccagtgtaggttataaataaaatagaatataaagactcagttctctattaatattcatttaatagaacataccagtcctatttctcatgtaaaaatcctatttgcaatgaaataaaatgcctttttagcaattataaatctaaacaccatactgtttaaacattacagaattattgtcaaactaaatgaagtgattaaaaattgaaaaaatgagaatgatcccttatcaggtagaacttatattttaaaagaaagactaaaaataaaataagaattatgatataaggttaattatgagagga

SEQ ID NO: 339491 - DNA, 404 bp, Homo sapiens
ggtgggaggtgataggaggtaaagtcagaggggtggggggcctgcgtaaagtctggcttttactctgtgtgagatggaagccactggagggttctgagcagaggacaaggtggtctgactcatgttttgaaaaggatcccgctggctgccctcaggggtcaagagtggaggcagagagaccagtcaggaaaccattgtgatagccttggtgactaatgatggcagcttggactagggtggtatcttgaactaggatggtatcagaggttgggggaatttgtccatttcctctctagctggcactctagacgttcttgctggtcaccagctttgggatcttgggcaagccatcttccccgctctgggccgtattagtctggattctctagagaaacagaaccaag

SEQ ID NO: 339492 - DNA, 3127 bp, Homo sapiens
  misc_feature (695)..(695): n is a, c, g, or t
  misc_feature (701)..(701): n is a, c, g, or t
tatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggtatatggtcagggtgctcatatcctgctttagcctagctgcttcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaaaaccctccatggtgggtcacttgaggtcaggagttcaagattagcctggccaacttagtgaaactccggctctnctgaanatgcaaaaattagccaggtgtggcacacgcctgtaatcccagttacttgggaggccgaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataaagttgaagagatacaaagggtagtgaagattctccttcccctcctgtaattcagctgtttagtttctattctcgcacagccctgttatcagtttctagtgtaagcttgcagtgacttttactttatttataagcaagtgttagtgggtgttgtcatttcttttaaaaatataaattatactgtacatgctattttgtattttggcttttctcccacctaaacaccctaaagatcattttctgtcagtatataaaatcttggtgatgccaatacccatcccttagattgtacaagcagcattttgccatgctttatcccatagcctgcctcctgcagtctcatctttttttctatatgcgtgtccaagtaagttgtagacatttttcacttttaatcctttcagcatacatgtcatgggaatttgtttttgtttttgttttttgtgtttgagacagtcgctctgtcacccaggctggagttacagtgacgtgatcccagctcattacagcctccacctcccagtttcaagcaattctcatgcctcagattcccgagtagctgggattacagatgtgcaccaccacgcctgactaatttttgtatttttagtagagatggggtttcatcatgttggccaggctggtctggaactcctggcctccagtcatttgcctgcctcggcctcccaaagtgctgggattacaggcatcagccaccacacccagccgtcattggagtttttttgagggagatttgcagtaaggtgaataaatgttaagtgtatcatttgatgaggttttttctttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgtaca

SEQ ID NO: 339493 - DNA, 679 bp, Homo sapiens
aataagtgccaagaagtagccacacacacattaaaaaaaaattctgagcccctgtaccccacctttgcatttagtggagtcataggactagctcacacccatgtgaacagagctgatgtgtctcatttctgggccaaggagtttaagaagtggggtttgtctcctttacattctctttttcctcttctgccagctctaatacctcaaggaatgtcagaatatgggacagaaggagccaggacatccaccttgcactgttctgggaggaagaaatacattttctggcctgcgcagggtggctcacgcctgtaatcccaggactttgggaggctgaggtgggcagattgcctgagctcaggagtttgtgaccagccttggcaacacaaggaaaccccatctctactaaaatacaaaaaattagccaagtgtggcagcgcgagcctgtaatcccagctacttgggaggctgaggcaggagaattgcttgaacccaggaggcagaggttgcagtgagctgagatcatgccactgcacttcagcctgggcgacagagtaagaatctgtctcaaaaaaaaaaaaagaagaaatacattttctgtatacttaaaaataattaaaatgaggagatcgagaccatcccggctaaaacggtgaaaccccgtctctactaaaaatacaaa

SEQ ID NO: 339494 - DNA, 410 bp, Homo sapiens
caaggccacccacttagtaaaatgtatagcctggatatcagccattcaatgcccacatcaatattcccaacaacgttaggcattaactaccagacgattttcagtgataccgagaaaggtgttgcgagctccataaatacagcactttccactagcaaacccagtgggattcttcaatacgtagcaagcctcgccccagttaacgttcccgttttgcagatgaggaaatggagacttctagaagaagtcagagagatctgagtttgagttcctgctttttcactcaccagctgcacaggtctctgcaaatcacgtaattccttggaggttcacccgtcctcaccagcaacatagggacaatatctgatctcaaagggctggtgtggggtaaatagaaggacagagcttgg

SEQ ID NO: 339495 - DNA, 246 bp, Homo sapiens
gtgtgttcactttgtgaaaattaattgaactgtacccttaacatacctgtacttttttgtatgtgtgtttttggatacttagataaaaatttacccaattaacaaaaatgcaatagaagctaatttaaccaagttattgcagtatttaagaatttgaggatgagggagtgtatatggaatggctatcttatactccaggcacataaacaaattcaagaaatttacctttttttttttttttttttt

SEQ ID NO: 339496 - DNA, 313 bp, Homo sapiens
atttctggtaagaaaagtagcagtaaatatatgcatactcgttttttttagacctttgcttttagactgtatttccttaaatctagaattcttttattgtacctttatattttaatgtgctgttttaatttggtgaatactggcgtagctcaccaaattagagggtttattgtatcatttaatttggaaatgtaaagggatgatttcttagaaatcctgatgtgagtggattgataggagagataaatatatatatatatatatatttttttttttttttaattttttgaaacggaatctagctctgtggcca

SEQ ID NO: 339497 - DNA, 375 bp, Homo sapiens
tcgaaaaaccatcacactagaaaacccatcccacatggttttaaatgcggggcactatggcagcctatttgtctgcctctaatgaaatctgcccctggcccatagagaggagcctagaggtagaagaaacagcattcaaaaggaggcttttaaatcccaaaagaaaaagatgccggccgggtgcaatggctcacacctgtaatctcagcactttgggaggccaaggcaggcgatcacttcaggtcaggagttcgaaaccagcctggccaacatggtgaaaccccatctctactaaaaatacaaaaatcagccaggcatggtggcgggcgcctataatcccagctactcggggaggctgagacacgagaatcactt

SEQ ID NO: 339498 - DNA, 520 bp, Homo sapiens
aacttaatgtagtatttcatgaaaaattgttgggttatctttggtcggagattatttttaaatgttcttaacagcacaaactaaaggctgtgctttttttttgtacttttttattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcag

SEQ ID NO: 339499 - DNA, 535 bp, Homo sapiens
cctggctcagaaaaaaaataaagtgacacaagctcctggaaatccaaagcagacctggtctgttactgactgaattgaaaagtgttcaagctatctgggatggttctgtttcttatcaagtgttacaaacatgctacacatggaatactcagcaagaaaaaaagaaaaaagcagcagcagatacacagggcaccatgtctgtcctcaacagggaaacccaataggagtcccactttcaccgttgcatctgagggctagggtgcagaacagtccataggtgtgaagctcagaggagtgacatagctgggctgggggaggaggtagggacacttcacggaagccactctgattctggctctcctggcctctaaccattcacggcatcttgccatctgctcagttcacctccacattactttcctttgtttacctcattctgttttcctctttaacccagaaacttaaaagtatgtgtgtgcatgtattcagtcatccactcttcaaaaatcacttcctgagcaccccccctccaccc

SEQ ID NO: 339500 - DNA, 675 bp, Homo sapiens
cacaaccaccacatgcttacccacaacctgcaacacctccctgacaccaggaacctggttacagccctcatacctgtgcatgcacggacgatagcctgtggcacatctctgatatcagagacccattcttcccttcccacgtatggagggacctcaggtctctaacgcctccccagacccttgcaggtacccaattaaaatcccaataacctttccagagacactccccagctcctccccaaaaccacagtgcatcctccaccaaccacaacacctttccaggcacatgttcacagccctagtacttaaccaaaacccacatttttatgaccccccaatacatccctaaacaccccaacacacacacaatcacacacacacacacacacagctatcacaccctcagcatatcaaccccctatccaaccccaacactgccagatacacccaggacccagctacagccctgctaccttcccactgactcataccctcaaagccctgacacctccccagacacacacactctgcccacagcccccaacgtttctcccagctatagctcagcacttccccaaacaccggtatcatcccctatacctttccaaacatacagcctccccctacaacacacatacactcactgcttcaaacacccactcaaacaagaacacc

SEQ ID NO: 339501 - DNA, 760 bp, Homo sapiens
taaggttcagcagtgtgtccctgtgtgctcaagggctggctgagtcctcctgggtggagtggcgccagttaggaggtatgggttcttgtctcaactctgtcagcctggaggtgctccatggtggccaaccctgtcatccacctgattcttgcttctacctccaggccagcagccctgccaacctccccatctgtcctctgcccctgtcacgccccacgtatctcggcccaatctctgctcagcctctcagagctgtttgttgtctcctgtttatgaccttctgttctcagctcttggcctttgctcatgcctcctcccacttggaaatctccctggagcagctgcgtgttgccctcatgcaggaaatccacatgggagccatccaggctgcccagctgtgggtccactgggctcctgcagcacccacctgagtggtcctgcatgttctgaagtgccccattggtgtgggaatcacctgctacttcttaaaggctaggacggtcttttgttcatttcgagggaagccgatggcacagctcccaagaactggattctggattccgacccagctgcacctctatggcctttccctgagcataacccctagctcccctgggccttgagtgtgcggtgggagaagcacctacccttagaagcacctaagaacatgatgagtaagcatgctttttaaactgtaacatgttctacagtatgtaagggcttgtcttcattgtggacccctaccactgccttcaaacaa

SEQ ID NO: 339502 - DNA, 284 bp, Homo sapiens
aattttcagcagtgtcaatatcatcatcatcaataagcatttttaagtacggtcatacatagcttaatgataggggcgcactctgagaaatgtatccttaagggacttcatccttgggtgaacatcacagaatgtacccaacacatacctacatggtagagcctactacacacctagctgtatgctgtagcctattgttcctgggctgcaaacctgtgcggcatgttactgtgctgaacactgtaggcaagtgtaacacaatagtaagcatttgtatgtctcaa

SEQ ID NO: 339503 - DNA, 236 bp, Homo sapiens
ccagcccataacagaactttaaaatgcagtaggatttgatagggtgtagaggattttttgtttgtttgtttttgagacagggtctcggtctcttacccaggctggagtgcagttgtgtgatcacagctcactgtagcctcaaccttccaggctcaaatgatcctcccacttcagcttcccaagttagctggaactacaggaggcatgtagtttgggtattttttgtagaaatgggg

SEQ ID NO: 339504 - DNA, 478 bp, Homo sapiens
tcaataccaagaagaatttcagaaaacatacaagtacacagaaattaacaacatgcctctgaatgaccattgggtcaaagaataaattaagtcagagattaaaaaaaaaaatttttgaaacaaatgaaaatggaaacacaacatactgaaacttgcgagatacagcaaaaacagtgctaggagggaagtttatgacatcaagtgactacatgaaagatactgaaagatacaaattaacaacctaatgtcatacctcaaggaactacaaaagtaacaaaccaaatccaaaatcagtagaagaaaagaaataacaaagatcagagcagaaccaaaaaaaaaacaataaaataaaaaccaaaaaacagtacaaaggatcaggaaaatgaaaagttggttcttcgagaaaataaataaaactgataaaccaattgctagagtaacaagggaaaaaaaagagacaacacaaagaaaatcagaa

SEQ ID NO: 339505 - DNA, 673 bp, Homo sapiens
aatgagttgcttactgaacaggtccataaagctcgggtgaagttcaataccttaaaaggtaagctccgtgagacaagagatgctctcagggaaaagacattggctttagaaagtgtacagctggacctaaagcaagcgcagcatcgaataaaggaaatgaagcagatgcatccaaatggggaagctaaagaaagtcaatccattggaaagcagaactcttcagaggagagaatacgtcaacgagaacttgaaaatctcttgcttgaacgacaactagaggatgctcgtaaggaaggtgataataaagagatagtcattaatatccacagagactgtcttgagaatggaaaggaagatcttctagaagaaagaaataaggaattaatgaatgaatataattatttaaaagaaaaactgcttcagtatgaaaaagaaaaagcagaaagagaagtgattgtgagagaatttcaagaagaactggtcgatcatcttaaaaaattttcaatgtcagagtctccactggaaggtacatcacattgtcatattaatttggatgagacatggacttcaaagaagaaattatttcaagtagaaattcaacctgaagaaaaacatgaagaattcagaaaagtttttgaattaatatcattactgaactatactgcggatcaaa

SEQ ID NO: 339506 - DNA, 434 bp, Homo sapiens
tgagaagaacagaaccgagagaaactttcagatttaaaggctgggaggaggatgagcctgcaaaggaggctaagcagctgtggtcaaagatcaaagaggtagtagtaaaaccatgaaagtagaatcagacgccaatggaagagtatcaatgataagaaactagaaaattataccaaatgctactgagaagtgaggtagtgaggactgggaaataaccaccggattgaaggataggaaggtgatcaccaaggtgaccttggcaagaaccatttcaacagaatgatggttgcagaagtcaaaatggactcggttgaggaatgaaaatgggaaatgacttgtaaaatggagaggcccaaactatccaactgttttgagaagtttaactgtaaagtagaaaagatagaagtgtaactggaggggaaatgaggtatgaa

SEQ ID NO: 339507 - DNA, 191 bp, Homo sapiens
aatagctttccactgtgctttcagttctcttctgtgtctccatcgtgaccacacaaaccctttgtgatctggccctgcctgcctttcctcctcactcacagcacaccagcgcccccagatcagaaacctcctttctgactccacctcacagcctttgcacttactggtcccctgcctagccacaagccacg

SEQ ID NO: 339508 - DNA, 353 bp, Homo sapiens
ctctgaaactcacctttctcttccccatggatgtggaaggagttatctgtcaccagtcagataactgtcaccagtcagttaactcctttcacacccatggggaagagaaaagatcggctcaaggtgtcaagaaatccctccttctagaaaccggagaagtaggggaaagcatcctcccactaataactaacttctaggttgaatgaagcccaggagcctgtgcttttagcaagaatctcaggggtttctgaaacagatagtcctcagaccacacttacagctgctgtgacttcacatgctggaatgacttcatacatgttaagttcttagaacagaagctggaactctaagca

SEQ ID NO: 339509 - DNA, 434 bp, Homo sapiens
agtctcgctgtgtcgcccaggctggagggcagtggcactatctcgactcactgcaacctccacctcccaagttcaagtgattctcctttctcagccttctaagtagctgggataacaggcgcgcaccaccacgccaggctaatgcccagctaatttttgtatttttagtagagacgaggtttcaacatgttggtcaggctggtctcaaactcctgacctcgtgatctgcctgcctcggcctcccaaattgctgggattatgggtgtgagccaccacgcctggccaggattccagaagtttttaaggaaggacatacaggtagggttgctataattaaataaaaaatagtagtgacttaaacaagatagaagtttctcatgttaacagtccatacttaacagtcctaggctagtatgacccaagctccttctatc

SEQ ID NO: 339510 - DNA, 537 bp, Homo sapiens
ccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaa

SEQ ID NO: 339511 - DNA, 486 bp, Homo sapiens
tttgtttgaaataggtattttccagtgtcccattttaatcccttgaagtttcttaaagttattttcttagtagttgtctttgggggataaacttaacatgttagtataatcatctattagggattaatgccagtttagttatttttaatttaaaaaaaatttgtgtggctaatgccattttaattatattatacaaagactttgcccctttataattccgttccttctcctctcccttgtgctcctgtcatacaattacctctcagtacattgtatgtccatcaacacatttagaattactgcttttgcagttgtcttttagagaaaaaagttagaaatggaaaagacttctgtactattttttctatttgcctatgcaatcacttttaccagcaccctttatttcctcatgtgggttcatgttactgtctagtatcttttcatttcagcctgaagaactgtctttagtgtttcttgcatggcagg

SEQ ID NO: 339512 - DNA, 486 bp, Homo sapiens
atcatgttcttccactcaccaacatctcgacactgatttggacacctctcccccttcagaatcctttatgtcctgggtgtttcttcttagcagcttcttccattctgcctaagaactcttgaatatcttcaataaactggagcataaactgactgcccttaaactccttcagctactcaagcaagaagaccttcaaaattctcaaaattggtgatggttttgaggaagggagaaaaacagccccacccaaccctctcaacagtacctaacagtcctcaggatgagccaggtttctcccatgaaatttcagatctctgtgaagcttgccaataccttcatgccagaaggtaaacaaatgacctgcctatccacagtgggacatcaagttctagcctctgggctctaatttctcgtggctcctagggtcccattacttaaacaagcacgtgtacttccctaagcagctaagccttttcccccagggta

SEQ ID NO: 339513 - DNA, 862 bp, Homo sapiens
tacaggcgtgagccaccactcctggttcaccctgctaatttttaaatttttgtgtagagatggggtcgcactgcatttcccagacttttctctaactcctggcctcaagcaatcctcctgccttggcgtcccaaagtgttgagacttacaggcatgagctaccatggtttgccccacaatgccttttattaagtacagaccatggtgtatatcgccttgtgaaaatgattcttttcctccctcttcaaattgaggatgctgccttgaagctccagcatgttgcagccccttaagtatttctcaggatgaaggagagaccattcagggcaattgcatcttccctggaggggctgttttcactgtgatgcccgcaacataccaagagcggaatcctgtctgaggagtgcagctccggtctcaccatgtgggcagggcaatcaccattaaccccagcccacaggccttcttaattgttaacagacattctgagaagtgcatgccctccacaaagcctacacacatgtgttcgagtgtgactctaggaaatgagcagatgtaatggaaacctcagtattgactcatcccgattgttatatatgagtggaatttgcatctcatttagtgtttatttcagtagattccagttgaggtcatggagtgctaaatttatatgcatcatagcacctttctcaaaggaattgggagctcttttgcaaaacaaaagatgtcttcttttcccttagcccttggttttgtttggaccagatggtgtaggtgaagagaacattagttgtggaagaggtatgtatgactcccttgggtacagtcattgatatttgttaaagacagcctgagagtctgt

SEQ ID NO: 339514 - DNA, 479 bp, Homo sapiens
gtacttgccaaggcatccagaatagtgtgcttacattgagtttttaccttgaattttataaagtattctttacatttcaaaatagttttatctgttctctgactcatatcttagagttaaacaggttaaattctcactgttacttgaggcatgaagaaaatgagacatggagaaatgtttttgttcaaggcagcactgctagcgaatggtaaaactgggattctgtgctgtttctgcctcttgatagaactccatgttcattgtaggtgggtctgcctctatccctactgtgattagaaaaggaggtcagaacacttagggtggaaaagcttttgggggtaagagctgtgagagaaatgaacagatcagtcagtagtatagaatcttgtatatgccaagcattctgtatatttatcaagaagagctcagtgtcggtacaaggggaagtatttcactttgaaaagtttgtttatttagag

SEQ ID NO: 339515 - DNA, 399 bp, Homo sapiens
ggaaaaagtgttggcttttgaagcaggcccaactgagtcactgtgaaaccttgtataagtccaacctctctgtgccttagtttcctcatctttaatgggactaataacatcttcgctctagagttgctataaagagagaagttgaatatgtaaagtatcttgcacatagttggaacttaataaatattctttattctgtaagttccttgaggctgaaaagtatcttctctaggcacaattcctggcacagtgcttgctacgtagtggggtcttactatagataatgaatgaataagtgaatgagtaaatgagtgaataagaagggagagcattctaggcagtgaggagtaatagaaatagcaggaaagttggaaatgaactgttgtgtgggaaaggact

SEQ ID NO: 339516 - DNA, 216 bp, Homo sapiens
gttgaattgctcattgctaacatatagcaatgtgatttttatatgttaatcatgcattctatattttaactgtgctaattagttctagcagtttttttgcagattccttcaaatcttctacataaacactcacattgtttgtgaatagagaaagttctgttttattttctccaatctgtatgcctcttacttctgtttcttgcctcatcacagtgg

SEQ ID NO: 339517 - DNA, 370 bp, Homo sapiens
cccaccaaggcccaccaggggtctacaccagcccagtcggcagggggaggcttcaatgggactgggctgtagcatgagggtcagggaagctgggagggtctcgatcttgaggaaagactgaccaatgaggcaaggtgtctggactctcgacaacttgacaacttggaataataaaaaagcatgcattggggtctctgtccctagttcctggcacagaactcttaaaacctcttgaatttcctgtcttttatatgttaatgagatgatacttaggggaggcggaggctagatagcttcaggatggcaggggctggtcaccagaaaaaccaaccacatgattctagaggtgcagaaggctcaggaagagggg

SEQ ID NO: 339518 - DNA, 1762 bp, Homo sapiens
  misc_feature (4)..(4): n is a, c, g, or t
  misc_feature (6)..(6): n is a, c, g, or t
  misc_feature (8)..(10): n is a, c, g, or t
gcgncngnnnagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaa

SEQ ID NO: 339519 - DNA, 566 bp, Homo sapiens
ttagaggatcctaagctccaacaagaactctagcagttcacaaaactttacacatgcgacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaa

SEQ ID NO: 339520 - DNA, 410 bp, Homo sapiens
ccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgctttgggatcttgttggatgcacttagatatggaaaatggaagccaaattttatctttaaagactgtattttcaaaataaaactttttcttgtttgtttcaaaaaaaaaaaa

SEQ ID NO: 339521 - DNA, 1573 bp, Homo sapiens
  misc_feature (4)..(4): n is a, c, g, or t
  misc_feature (6)..(6): n is a, c, g, or t
  misc_feature (8)..(10): n is a, c, g, or t
gcgncngnnnagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaa

SEQ ID NO: 339522 - DNA, 1542 bp, Homo sapiens
  misc_feature (4)..(4): n is a, c, g, or t
  misc_feature (6)..(6): n is a, c, g, or t
  misc_feature (8)..(10): n is a, c, g, or t
gcgncngnnnagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaa

SEQ ID NO: 339523 - DNA, 1843 bp, Homo sapiens
  misc_feature (4)..(4): n is a, c, g, or t
  misc_feature (6)..(6): n is a, c, g, or t
  misc_feature (8)..(10): n is a, c, g, or t
gcgncngnnnagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaa

SEQ ID NO: 339524 - DNA, 115 bp, Homo sapiens
actatgtcatggaagtcagtgcattcattatcccttttacaaatgttgttttaaaaagcacccacaacatgcggttcccagccgggcgcggtggctcacacttgtaaccccagca

SEQ ID NO: 339525 - DNA, 425 bp, Homo sapiens
tccctgctgctgatgagatagcagcactactgatcttcaaccagctgtagaagtgataacagaaccctcaactctctgggtgagaaactttagcaatcctggcaataatagctaccatttatttagcactagctatgtgccaagcactgactatagcttagggatgaacaatacaagctttggaatcagatttatcaagacaagagcccaaactgcctttcaccagctacctgactttgagcaagttactcaaccccttaagacccaagatttaagacatctttatctataaaatagaaatagtaataataacaagtcctacctcatagtgtgatttacagaatcaagtaaaataatccactcggccaggtactgtggctcatgcctgtaatcccagcaccttgggaggctgaggcaggtggatg

SEQ ID NO: 339526 - DNA, 206 bp, Homo sapiens
cctaatccactgctatttcccaaggctgattctcatcatatcactcttctgttctgctcataaatctctagaggcacccagttgtctactgcattaagtttgtccccactgatggggcgtcatgccaagccgacctctgctttcctaatgctcaacagccctgatatgggaaatgttactgacacaccacagttagaaatgcccac

SEQ ID NO: 339527 - DNA, 666 bp, Homo sapiens
ccaccagccacttaatattttttcttaatctgtcattatcttgattttttaactattttctgtccttccccactatactgtaaatttcatgagtgcagagatcttgccggtcttaaaattccaacaaggttaaagaagctactgtttccctctaagcaggtttattttagatttccccctcctttcaagctttattggattttagtctagtcaaagattataattactttggcatttaccataaaaaacaaggggagaaaaaccagaagtgacttcccttcaaaaactggaagtcactccacccacctagtggtctagactggacacagactgcacagaggtatccaacaaatgctccttacaaaaactttccaatgtggacatatgcaaagatggtataattctgacatctgcatcaaaaatctaagttttaaactactctccctagcaattactaaacacaacgatttgagaagaatcaacaagagaaagcacaaaataaaatccatgatccttaatccagagaaattaatgatttcatcactgacttggttctttctcattttagtaaggtcatctattcatcacctgctctagatgcttcttcctgacctgtgttttttgtctccaggctggagtgcagtggcgcgatctcagctcactaca

SEQ ID NO: 339528 - DNA, 152 bp, Homo sapiens
ggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggag

SEQ ID NO: 339529 - DNA, 453 bp, Homo sapiens
tttttttgtggagatggggtttcactatgttgcccacgctggtcttgaactcctggcctcaagtgatcctccttccttggctttccaaagtgctgagattaccaacatgagccactgtgcctggtactacctttatcacatactaaatttctttatgtacttgggcttgtctttggactgttgttaagaactgatctcattttctcgttcagtggagagatgtatctcttcatttattaaggtcttatttgttgaaaacagacttatttactctctctctctctccctttttctctgttctctttttcttttgcagtcttgttaaacagtgtttttggctagggactttacagatttttactgcataaatgagaccatccactccctaccagtaccactgtggttaaatttataattgtttatcagtagtgtatgttaatgtcatatccagcc

SEQ ID NO: 339530 - DNA, 529 bp, Homo sapiens
atgtgttttgtgtgtttgtgtgtgtttttttttctttaaaagagagaggggaggagatctccattccaggattggtgctgaagcacatgtgtcctgaagttcaggacgtcagggtaattgacacagaagaaaagtgaggcgaaggcaggcagcaagctgcctgtatttttgagacatctccagagagggcaggtctgcagacgggcaggtctgcactttgcagcaacagtctgcaagcccagacaaggcccccaaggagacacaagcccagcccaaatgcagtctgagtgttaagaaaggaaagggcctgggattgcaaagcgcgaggccaaacgcctcccccgaccttcccttcgcgtggcacctgagaaaggggcagcccagtgcaaatgctaggtgtgaccaaccaggccccggagaagcgattctgtgaacaaggatgactagcccgctagtagtgcttgccgcaagccgcccatgcatcccaagtgctttccacccatcacctccctaacctgtctcagggagg

SEQ ID NO: 339531 - DNA, 585 bp, Homo sapiens
atttttattccactgaattgtttgcttcagttttaacataattaacgaaactttattaatatttagtagacatctactgcatgctaagtgatctacagacttcccttgttgattctgattcaatggtacttaagcattgcatagaaatctgtttttaaataaatactaagagttacgggtcatcagataaggatggtaaatgccctattattcaaagaagaaaacacctgtctaaggaacatggcctctaaaggtagcaaaaattctattgcttccctattttttagatgtttggtccagaaagaagtatccaatgtcttatctgttagttaccaagctatctgtttacagatcacatgatctgaaacatgaaactgcattcataaatttttaagaaatctaggttattagaaagtcccaacatttgaaaacttccattttaatgttcctcttatctgaaatttgttagactccatcctcttcagtttacctcttaagctgtcagcacctttctatgctctttttcttttttctttgagacagaatcttgctctgtcaccaggctggaagtacagtggtacaatc

SEQ ID NO: 339532 - DNA, 529 bp, Homo sapiens
acgggtagaataagagacagaaagatgtggtagaaaagtgatgttcaggcaagagatgacaaagtctgagcagtgcagacaaaggagaggaaagaatgattttaaacagaattaagttggtagaattgacatgatttgctgatgatctggataagaaggtaagaaagaaggaagagacaagaactatttacaggtttctgtcttagcaatgggaggcatggcaatgctatttactgggacagatacacaaagggaaaaacaaaatggggcattggaagactcacactccctgatttcaaaatttactacaaaactacagtaaacaaaacagtgtggtagtgacataaagacagacatataggccaatggaacagcatagagaacctagaaataaacccttgcatatatgtcaaataatagttaacaagagtgccaagaccattcaatagggaaaagacagttttttcaggctgggcacactggctcacacctgtaatcccagtactttgggaggctgagataggagaag

SEQ ID NO: 339533 - DNA, 166 bp, Homo sapiens
taacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacagg

SEQ ID NO: 339534 - DNA, 322 bp, Homo sapiens
ctcctctgggctttaactctgccggttttcctagagctttgctcagtcctgacaggtgtgaggacctgaactcagggcttgggatcttatctcaggttctcctgctttattgcaaggactcggggtcctcagcagatcttggcattctggagggtgtcacattattggtgtgcatcatcgttaagggtctttggaggggatttctgtctggcatttggaaattgcagaattgactttctaaatgtatggagtagctggcgacaaaggggggtcacattgtggaggaacaggggccagtgcatcagtaaagagcaggagaggc

SEQ ID NO: 339535 - DNA, 316 bp, Homo sapiens
aggctttgcaaaaagacggcgggaaaatgtttttggtagatggagaagggaaagggtggcaaggaggatgggagaaaaagatgatagggaaacagtttttgggtagatggaaggggaaagagagggtggcgagcagcaggagtggggagaaggctttgggaaaagatgagggaaatgtttttggggagttgaaggagcaaaagaggatgatgagagcaggaggtggaaaaaaggctggccagggagagggagaaaagacgttggggaaaagttttggggtagatgggtggggaaaatggaagtgagcggtaaagta

SEQ ID NO: 339536 - DNA, 399 bp, Homo sapiens
tctctacaggtgctttgtgctgttcaagtgtagtgttccaaagcaaatggctatttatttacgaggccattttggtgagtacaaaagttggccagtagcagactttgaggtagaagcagaaggtactgagctctgcataataataaagtgggaggacatttgagttctggggaaaattaggggagaaaaaaatagaaatggggaagaaaaatgattagaggtaagtggacaaaaggattttggagcacactgaaatattcaattttaaattatttgctttccttttctgcaatagaaaccattcaattatctccaagtattctgatactgcttagtcaatagtattttgcgaagtggagatcagaagtgtccaacatgtggtgatgtggtacagaaaag

SEQ ID NO: 339537 - DNA, 341 bp, Homo sapiens
cctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttat

SEQ ID NO: 339538 - DNA, 218 bp, Homo sapiens
gatatgtgtaggttatatgcaaatgtaacaccatttaatatgacttgagcatctgcagattttggtactcttgggggggtcctggaaccaatcccccaaggatactaagggatgactgcattataagccactaaaataagaaatcagtgagttacacagccaataacccaacaagagattaaacagaatcagtcagtaattacttgacctgaaagaag

SEQ ID NO: 339539 - DNA, 231 bp, Homo sapiens
gcaggagaagcccttgaacccgggaggttatgggaagctaagatcacaccactgcactccagcctgggcaacagagcaagattccatctcaatttaaaaaaaaagtgagagaaaaagagagagagaatagggttagtaattagggttaaaggttggggttgcaggtcaggcacctctggacattcccagctttggttcttcatgtgtctactcttcctgcaggtggtttga

SEQ ID NO: 339540 - DNA, 539 bp, Homo sapiens
aatgctacaacaaaaaacttagaagtgtgaattgggaagaattttactttgagtgaagaacctttttcaatgcaggcaccaaactcaaaatcataaaatgtcacaacttggaaggggcattggagatcacctgcgttctcattgtatagattgggaaaccgaggctggaagaggcaagttggctttctcatggtctgtcagatccttagaggctgagttaagagtagaatccagattttttacctccctattatctccaggtgtgtttaatgtttgggataagattaacatcccccaaggtgattcataaggaaagtgagaacaaatgtagataagggtttgaagcgtaattatctctggcattagaaccacacacccttcctcacagttgtacctttagccttgaacaggcttcctggtactcacctggtctaatagtgatttttatggtgcttaccatgtgccaggatctctggttcaagaactccttccgtcctcagcaactctatgaggtagctgctagtgtgatcctatcccca

SEQ ID NO: 339541 - DNA, 269 bp, Homo sapiens
agcaggtgaggataaacaagtgaaaatgcaaaggaaagttgacgcacataagggaagacaagtgagtcaccactgaggatggcaaaggggacaggcgaaaggctcacaggttagctagcatttggaagcagggcaagagtccgggccagaggcggtggctcacgcctgtaatcccagcactttgggaggctgagccgggcgatcacctgagctcaggagttccagcctgggcaaaacgacaaaaccccgtctcaaataaaaaaaaaaaa

SEQ ID NO: 339542 - DNA, 529 bp, Homo sapiens
caaagacacaacgttggaactataaggaataattttttcttaattcactatgtatttttctaacacttttcttggagcttttaatccttagaacctaggagatggaggactatacactcgggtttacttttctttcattttcttcttctgaattcttttttttaacttttaagttcaggggtacatgtgcaggtttgttatataggtaaacttgggtcacaggggcttcttgtacacattattttgtcacccaagtattaagcctactacctattagttttcctgatcctctccctcctcccaccttctaccctctggtaggccctagtgtgtgttgttcccctctttgtgtccatgtgttcacatcaattagctcccactaataagtgagaacatatggtatttggttttctgttcttgcattagtttgctaaagataatggcctccagctgtatccatgttcctgcaaaggacatgatctcattcttttttatggctgcagagtattccatggtgtgtatgcaccac

SEQ ID NO: 339543 - DNA, 149 bp, Homo sapiens
gaatccaaacacagaccttacatatttcataaaaattaactctaaatagatcatagaccaaaatgtagaagatgaaactataaatcatctagaagataacgtaagataaaatccaggtaaccttgggtttggcaatgacttagcaccaa

SEQ ID NO: 339544 - DNA, 566 bp, Homo sapiens
aaagtcccctagggaagtcatctgacagtcctggtcactgtctgtgctttaaagctggctgttactgaagcctttaatgcatactgtttttcttcccaggtaatctgcaatagtaattatggtttagttgagtggcctcccccagttgagaaacacaatcataccatgcagtaaaaaatatttaaagcacacttatagttctagaactttgcatggataactctaattagtctgggagcgcttccctggagccgaatgtgtttaagaattcaatcttttaagtgccggtgatgtcagtttggagacagcagtatgtggctccattccaccgtgaatcctttgctagctgcagtgtactttagctaatagaatcaagtgcttgtcttcaagttttttaagagcataaaaaccctgtttattaaaacaattctctttggcactttgcagcattatgataatgctgtcttagcagaagtgtagagagctgtgaactcctagggggaggctctggaggaggaccattctttcccattgtatttcttcgggacaagcatcattcttctcct

SEQ ID NO: 339545 - DNA, 342 bp, Homo sapiens
agtagaatgttattcaaattgtttggtattaggtgacttggtatgttagcgctactgaagcaaatatatagacaagactttggctgattggcaggattttgactagattaatcagacatttgagcattatgaaaaacaatcatttttctttaacaattattgccttttaaatgaataagctaatatgaaagtgacaagtgagacctcactaggggctgagatagctaacataaatatgtaagttatggcacagacagaaagaatgacaaaaatttacacatttaaaaacattttatcaattaagaatttcctgtttaataagttttataaaacagtaaagta

SEQ ID NO: 339546 - DNA, 457 bp, Homo sapiens
tagcagcaggttctttctctttatcttttctatcccttagacctgttctaagataacaaagatgttgagggggaccccttgggattaccaccaccatttctctaccttgaactcctgagagttgaatgattatataactgacagaaatcaagagatgtgatgatgtaaatattattatgacttcttcactagcatctgtataagtgtttatcttcatacagagaataggcacttaataaagatttgttcatggaatgtacaaatcaggtgagcagttcctgtcacttaacaaggactttaagtaaaacactaaataattacagaatctcctctaaccatgagctgcttctctgagtgggctgtgttgatgcctagtcaagaaatttcacacactattaatcatttcagtgtatagctttagtccttgaaagtcaccctgggggaacaagaatgtgtc

SEQ ID NO: 339547 - DNA, 155 bp, Homo sapiens
cctccatgtatcatcactcagcttcagtaattaccaggtcatgctaatcttatttcctgtattccttcattaacttctcctcttcccatgttaaagcaaatctcagatattgcagggatatcattatatcaatatgtatttctaagaggaaatga

SEQ ID NO: 339548 - DNA, 211 bp, Homo sapiens
gagaaaactcagcttggggtaggggttgcaaactcaagtgctaggtagtgtacaccgacaaggacagtgtgacccactgtgggactgtggtaaactctgcaacgcacacatgtacatccaaaaggagttgtgtccctcagtccagcagaccactgccagtgtaagctcagacggtgtgattttcagatttttcaagagaggccagaatcca

SEQ ID NO: 339549 - DNA, 551 bp, Homo sapiens
aaacagagacaacaggacatctatagatatatctgaagatataagaggaaacattatgggaattgctcacgtggttatggaggtagagaagttccatgctacgcatctgtaagctggaaatccagaaaagctagggtgtcattcagctcaagtctgaaggcctgagaagtaagagcaagtggtgtaagttatggagtctgaaggcctgagaaccaagagctccattgtccaagggcaggggaagaagatggatgtcccagctcaagatgagagagaattcacccttcctccaaattctttttgttctgtttgggccctcagtggattggagacgcccagccacattggagagggacgtcttctttactcactgtcacagacacacccagaaatatttcaccagctcttggacatcacttcaccgtctcaagttgacgcataaagttaaccattacaagtagccttgaaagactctatgtgtccttcctaatgaccaggagatgtgagtcttgcattgaagctagagaggttcaggctggacttgaagcata

SEQ ID NO: 339550 - DNA, 786 bp, Homo sapiens
tgtgaggctttctcaggaaggccttcccccaaactaagaaagagcaccatattatcctcgtgttttctccatggtgcttgcttgttcataagactgacttaatggctgtcttcccaaccagactgtaaactcctgagagatggcactgcatctgctttcttcaccatttattcgaatgtgtagtgcctggcacataacaggtgctcattaaatattggttggctgactgcatagttcctaacccttatatttactttcttcgttaatggtacccctatagttgtttgttttcataatatcatattctccacatgttctatgaactacagccattttcatataggaggtattcaaatacaggcatgccttgttttattgagctttgttttattgcactttgcagatatagtgcatttcttacaaattgaaggtttgtcgcaaccctgtattgagcaggtctgttggtgccattttccaagagcatgtgctcgcttcgtggctctgtgtcccatgttagtaactcttgaaatatttctaactttttcattatgactatatgtattatgctgatctgtgatccatgaactttgatgttcccattataattgttttgaccatgaaccttacccatataagacagagaactgaataaatgctgtgtgtgctctgactgctccaccaaccacccattctcccatccctgtccctctcctcaggcctcctcattctctgagacaaaacaatatagaaattagggcaattaatgaccctgcaattggctctaag

SEQ ID NO: 339551 - DNA, 177 bp, Homo sapiens
atggccagatgtgtaagtatgtacctgtagtccaaatactcatgaggttgtggtgggaggatcactggaggccaggagtagaagggtgttgtagggtactatgataagacctgcagataactactacattccagcctgggcaacacagtaaggccctgtctctaaaaaaactaagca

SEQ ID NO: 339552 - DNA, 793 bp, Homo sapiens
cctgccctggggcccttctaagaggaagatggcccaggagaagtctctagggggtgcctctcaactggccctatggagaccctttcctgcctgcggagagagactctcagccactcccccagggccggccacctcccagccattgcctggtgtgcggccgcaggggatgtccaagaaaccccaaaagcctaagcacagcagccctgggaagaaaccagcaggaaggaagaccagggagtcccaggctgtggcgagagaagataatgacccaaatagagatgaggtcccaagggcccaacttcccacacaccggccaggactgcctcgcctatccacgcatcgtggagaattcagcagtagcgactccaacatcagagctccccaagttctggggacttcagagccctctgcctacagcctgggaggcctcgtgcccagacgccatgcaccctctggtgactggcagccacctgtccatcccccaagaccggaaaggcagcaatagcccccgggagcccagggctgtcctcggtgcatccggctgcagagggaaattgaggaccttagagaccaactagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttcctctgcatttgcacacttcccaacgcagttcaaagcaatttgaaataaagtcgttctcatatt

SEQ ID NO: 339553 - DNA, 408 bp, Homo sapiens
atgagttaagaggtgggtgttagaggagtggaatgtttttgggagtagttgttatgtaagaaaatattcagtgactggcagccacctgtccatcccccaagaccggaaaggcagcaatagcccccgggagcccagggctgtcctcggtgcatccggctgcagagggaaattgaggaccttagagaccaactagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttcctctgcatttgcacacttcccaacgcagttcaaagcaatttgaaataaagtcgttctcatatt

SEQ ID NO: 339554 - DNA, 1078 bp, Homo sapiens
cctgccctggggcccttctaagaggaagatggcccaggagaagtctctagggggtgcctctcaactggccctatggagaccctttcctgcctgcggagagagactctcagccactcccccagggccggccacctcccagccattgcctggtgtgcggccgcaggggatgtccaagaaaccccaaaagcctaagcacagcagccctgggaagaaaccagcaggaaggaagaccagggagtcccaggctgtggcgagagaagataatgacccaaatagagatgaggtcccaagggcccaacttcccacacaccggccaggactgcctcgcctatccacgcatcgtggagaattcagcagtagcgactccaacatcagagctccccaagttctggggacttcagagccctctgcctacagcctgggaggcctcgtgcccagacgccatgcaccctctggtgactggcagccacctgtccatcccccaagaccggaaaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttcctctgcatttgcacacttcccaacgcagttcaaagcaatttgaaataaagtcgttctcatatt

SEQ ID NO: 339555 - DNA, 847 bp, Homo sapiens
catccacaagaaacggtggaagccctgggggccctggcctggcccgggtgcaggctgcatggccgggcggggcggtgtctcctttcacagcttccccgtctgtccgcagcctccaggagccccacacagggctggggctctgtgcccccaactcacacccgtcggctcccccaggaggagcaggctgggcccagagccgcagggtgggctgcagggaggtctgacttagctggggaaagtgccatccctgccattgctagtgacaagctcgggctgctgtggccccagcacagattcaacactcactgcgctatgtgccagctgttgcacactcacctccacacccaactcacaggaagcaaggctgggaaggagggaactggccccaggccacacagatgctgcgagttgggattatgatcgggtgcagtggctcacacctgtaattccagcacttggggaggccaaggcgagtggattgcttgagcccaggagtctgagaccagcctgggcaacatggtgaaaccccatctctacaaaaaaaaaatacaaaaattagctgggcgtggtggtgcgtgccggcggtcccagctactcaggaggctgagatgggaggattgcttgagcctgggaggtcgaggctgcagtgaactgtgatcacgcccctgcactccagcttgggtgacaaagcaagatactgtctcaaaaaactcgagttgggatttcaccctgcgtggtccagcactgaacagcgttcacacctcggtcagctcagccccaaaaacggggaaggccgggcggggtggggacggcatgcgggcaggcccgtggcttttcggaggagtcc

SEQ ID NO: 339556 - DNA, 735 bp, Homo sapiens
gcggccgcaagaacagtagccgcccagggactaagggggcttctgggaggacacacggctggcccagggcgaggggtgtcactgcagggcgccccccaggcccagggcccgtcaggggacagtacggtgacccggcctgcaggtggcagtcagttctgtgtgtctggggcccgcagcacagattcaacactcactgcgctatgtgccagctgttgcacactcacctccacacccaactcacaggaagcaaggctgggaaggagggaactggccccaggccacacagatgctgcgagttgggattatgatcgggtgcagtggctcacacctgtaattccagcacttggggaggccaaggcgagtggattgcttgagcccaggagtctgagaccagcctgggcaacatggtgaaaccccatctctacaaaaaaaaaatacaaaaattagctgggcgtggtggtgcgtgccggcggtcccagctactcaggaggctgagatgggaggattgcttgagcctgggaggtcgaggctgcagtgaactgtgatcacgcccctgcactccagcttgggtgacaaagcaagatactgtctcaaaaaactcgagttgggatttcaccctgcgtggtccagcactgaacagcgttcacacctcggtcagctcagccccaaaaacggggaaggccgggcggggtggggacggcatgcgggcaggcccgtggcttttcggaggagtcc

SEQ ID NO: 339557 - DNA, 1078 bp, Homo sapiens
gcggccgcaagaacagtagccgcccagggactaagggggcttctgggaggacacacggctggcccagggcgaggggtgtcactgcagggcgccccccaggcccagggcccgtcaggggacagtacggtgacccggcctgcaggtggcagtcagttctgtgtgtctggggcccgcagcacaggttgggtgggggctggggcaggggcagcagaagtgggcaaggcctggggggctcaggcactgggcgtggagagcagacaggaagctccagtgggcaccaccccgggaccgcggctcccacccgtgctgccccccacccatggccacggtcaccaggaacagcgggacctggggtctccgagggactcagcagggcgggcacagaccagtggagtccgggctagagagggccagctcccagcctcttgcttcctgggctgaggacatggggatccaaggccagtgggtctgcagggcccagcccggctgcctgataagataggctgagctcctccctgcacggctgcaaagacgcccacctgtcttattggatccccacaggaatagacccaccaggcggcccccgtgtctcactctgtcagcaggtccccagggacctgctgccgaggggcagtttctggaggctgggggcactggctgggctctaggcctgctctgcccttgccgtggggaaggccaccccgataggggtcaagttgctcaaatctgcgtttggagggtgtgtggccgagggctccctttctggagacccagacaccgcctgggctccgggcggcagaggctgaggtgtcaggggctgagcccctatgtcagcaacacctcaggcctgcactttaggacaggggagaagtcagtttccgccaaatgccccctcagaccagccgaggactgtgccaggaaactgacatgctcaacgctcaagccagctgggacagcgaccgagcccagagagacggagcaagttgcctgaggtcacagagcagggacttggacaccaggcagccggctccacagaggccctctctcctccctgcctcctggccattcaacgcctccg

SEQ ID NO: 339558 - DNA, 461 bp, Homo sapiens
cagagataatgtaaacttttgggcacattacttttggctactgctgaattctgaaataattcctgtagatagttcagaaggatatgagtctatccacattaataggtgaaaacactctaatattggtgcttaggaagtgtatcgccattcaaatacttgttatatgaatgactgggcaataaacttgagtcagccattcttccagggtttaaagtctagctccatctattactattgtgtgacattgggcaggtcacctcaactctttgagttcgtcatctaatgaggaaagagatgatgctaatagtgcctttctcatagtgctgtgaaattagatgagataatgcatgagacaatgtatgtgaagtggttaacatagtcctggcctgcagtaggcactcaaatatttttgctgtttttgttattattaagctaataagccaatttggtaccactgacac

SEQ ID NO: 339559 - DNA, 905 bp, Homo sapiens
ccgattattgcatatatgatctttaattagatccaagatttttaaaaatacagctataaaaacattattgggatgctcagggaaatctgaatctagcttgcatattaggtaacatagttgtattaatactacatttcttgggtatgagaatgatattgtggctatttagaagatccttgttccttggaaacacatgctgaagtatctacaggtaaagcggaatgatgtctgcaacttgcctttgaatatttaagaaatatattgacatggtttggatatttgtcctctccaaatctcatgttgaaaaaggaatataaatcattctattataaagacacatgcatgcatattttcactgccgcactattcacaagagcaaagatacggaatcaacccaagtgcctatcaatgatagactggataaagaaaatatggttatatatacaccatggaatactatgcagccatgaaaaggaacaagatcatatcctttgcacggacagggatggagctggaagccattatcctcagcgaactaacacaggaacagaaaaacaaacactgtgtggcatgttctcacttgtaagtgggaacggaacaatgagagcacatggacacattgggggaaacaacacacactggggcctgtcagaggtgggggctgagggagagcatcaggaagaatagctaatggatgctgggcttaatacctaggtgataggttgatctgtgcagcaaatcaccatggcacacatttacctatgtaataaacctgcgcatcctgcacatgtaccccagaacttaaaatacaagttgattaaaaataaataactaaaatataaaatttaaaagaaatgtgattcccaatgttaaaggtggggtctggtgggaggtgatcggatcat

SEQ ID NO: 339560 - DNA, 183 bp, Homo sapiens
ccctctcctttaaacatgtctgatttgtaacccacctcttcagaattattcctgtatcttccaaggtgacctgacggtaacagcaagtggcacaagcacactcatttcccggtgatagctttaaaatatgttcacaatggccaggtatggaggctgatacccgtaatcccagcactttggaag

SEQ ID NO: 339561 - DNA, 263 bp, Homo sapiens
tatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggta

SEQ ID NO: 339562 - DNA, 151 bp, Homo sapiens
atagtaaccatcttaagatggaggttgaagtagaaatcagaaggcccaggatggctatgagtaggcccccactgtaaattaccaccttcctacagacccctcatttctcatcaataatgtaaaaagtatgtaccttcttacccaaacattc

SEQ ID NO: 339563 - DNA, 1353 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacata

SEQ ID NO: 339564 - DNA, 1273 bp, Homo sapiens
aaccttttcacctgtctgttctggcatgcttctaatgatgtcagagtcacctggatcaatgataggaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 339565 - DNA, 833 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagcccagccactcaactcctgcttgtttttcctttggccataggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 339566 - DNA, 1423 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 339567 - DNA, 758 bp, Homo sapiens
gtcgtgacatacatttctccatcgaagttcgtctccaggaggatcccctgatagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacata

SEQ ID NO: 339568 - DNA, 510 bp, Homo sapiens
ggttggagagcgatggatttgagaaaagtcgaagagattagtggatggggctcagtgggttttgcagagtgtgtgtgctcgagtgctagtagcagatgaggggactccaagatgacttgccagccatattgctgggagttggtgactatacaagtgatagtgttaatttttttaggtaaacaagaagaaacagcttgttgttgatagtgggaagggtgaatgagagggcaataagctgtgtcaagatgctttttgagttgttcttggcttatatgcgtattctgtcttgagataaagatttagaagtcattaccataataaatgtggtttgagaaatttgcagtgttagatgttatggcataggaagagtaattaataccagatgaaaaagagattttaacaaaagttgacctttccccacgttttctctaccacttttttaaacatcagtgttccctgggttcctctttttcatctggtattaattactcttcctatgccataacgtct

SEQ ID NO: 339569 - DNA, 231 bp, Homo sapiens
ctctggaattagccatttctccagggagccctgttcctcttagtacaaagtggcatttagaaacaatgatctgggcactaggtacgctaaatgctgctggagtgttgctcttcccaggcccctttcagtggacagagctaggaaagacatacatatggatgcatttgcttacatatacatgtacatttacatctttatttctttatctatctatattgaaaatcatgagtt

SEQ ID NO: 339570 - DNA, 292 bp, Homo sapiens
ctgtcacttttgctcccatattgccatcgtattttgcaactttagacatccttttattaaactaacaactgcactaaataactgatacactaataactgatttttttaagttgaaacaacaaaatagtacacacttaaaagtaagcttccttccaaaaaaatcagaatcctggttcctctttcaagagacaaccactcttttttttttttttttgagacagtcttgctctgtcgcccaggttggagtgcagtggcgcaatcttcactcattgcaacctccatctcccgggtt

SEQ ID NO: 339571 - DNA, 514 bp, Homo sapiens
tccatttgaaatcatccaataaaagacctgagaaacctattacatggtctctggggtaataaaagtaaataaaagttttttaaaaatgctccagcctgggcgacacggtgaaaccccatctctaccaaaaatacaaaaattagccaggtgtggtggcgcacgcctgtagtcgcagctacttgggatgctgaggtggaaggatctcttgagccctggaggcagaggttgcagtaagctgagatcgtaccacagcactcctgggtgatagagggagaccatgtctcaaaaaaaaaagaaaaaggctgcgtgcagtggctcacacctgtaatcccagaactttcattggccgaggcgggaggatcacctgaggtcaggagttcaagaccagcctggccagcaaggtgaaaccctgtctctacttaaaaatacaaaattagccaggcatggtggcatgttcctgtaatcccagctattcgggaggctgaggaaggagaattgcttgaacctgggaggc

SEQ ID NO: 339572 - DNA, 233 bp, Homo sapiens
aaatttttttttaagtggaactttttaaaaattaataattaaaaagtaaagcttcttcaaagctaagtgtgcaacagacatcagcctgcgatgcttttggagccatgtcccagggttttctctttggagagaaaagactttgcaaaaagttttgtccctgattttttctggtccagtcttcgcgtctgaatttagtatgcctccttattgtaagcacaagttcataccactcc

SEQ ID NO: 339573 - DNA, 385 bp, Homo sapiens
taggttctttattctttcatctttatctttctatgccctctaaatttgcttttgggtttttttaaaacttttatatcatttgttcacccattagtcatttagcacttgacaatttgacaatgatagctctaaaggaatatatgctctgttttgggatatgtgtgtttatctgtgtctgagtgtgtgtgtgtttgagggttgtttatttgaagagccagtttcatcttttcccgcatgtgagtatccagatatttttggtatttgccttctgtctctttcaatgctgatactggatatatcattaatacattaatttgaataaagctaaatgcctaaaaggatcttcatgtgataaaataaattgtctttcctccatgcatagaat

SEQ ID NO: 339574 - DNA, 959 bp, Homo sapiens
acaactcttgaaaagaattaaaaggtcatgctgaatgtggactttgctttcaagggggtcactccggctgagcactgaaattctgctggcggtaagatgaggtactgggtaagcgtcttcatttctttacagggactcaggcctagcctcatccccctctggcttttgttgagcaagcagacccttctaggaaatgctcccatgctgatctctctttctccttttgtttaactataaaataggttagggaaaagttgcttgtgttttcatattctctccccatttttgtcttaaaaacacatacactatgacagaaactatgaattcagccctcatagctgaacataaagagaatgaaagaggctaaacaggcctctgtgaacaaagcctctgaaggactgattttaatggcacagttttggcatggcttgctaatgaggagcacacctccaggacttccaagaacatgcacaattcctggctgcgtcctcaaacaagtggggctatagcctcagaatctttcatcatcagcgtggtggcctcctattttgttgttgtccatgatgttatttatttttatttttaaacctaattctagacttcaatcccagcagataactgttttgtgtaagcagtaaataacagagttgacttctccatggcaccaaactaaacgtctctgcaaagtaaggtagcccctcaactgtgtctggcattccttcctgtggtgaccacctctatatgtctgtgaagttggagaagcagagcacgggaggggcacataaatataaaactggcttaggaacttacatgatgctataacattaccaagattttaccagttagtataaatctagagtcttttatgaccataggcaacttccatttttgaaaatagtatgaaatttttatagtataaaagcttataaattttctatcatctgtgtttaccttccaga

SEQ ID NO: 339575 - DNA, 511 bp, Homo sapiens
ccttctctgccccagcgtatctagatacatacattccatggtctggtgcatttgatgctgtttgagttagtattggtcagtgattttggcacccttccttccttatgttcctataccaaggctttttatacgaggtatcactgtcttcagaaatatggatggaatgaagttccatttagaccctgacatgagactagttctgttctcttttgttcttttagaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339576 - DNA, 1990 bp, Homo sapiens
cagcaatcgcagccatggcgtcgttactgtggggaggcgacgcaggggcggcggagagcgagcggctgaacagccacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgcgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattctaatctttgtacaggtaatgtctcaatgtgggctatgggggtgtttttggatttggttgatacaatctgagcagatcgtgcctcttgggagcatcttactgtgtcacaagagggcggtagagcttcgctgattttggaagcggagcgagtaggaaaaagcccatgtcttcagacctcactcacaggtgccctttccagccatttatgcctttccccgctccccgccttaaactcccccatgcatgcacatgcatgttcttaagtgaaagtacagattaaaacttttaaaaagtgaaac

SEQ ID NO: 339577 - DNA, 721 bp, Homo sapiens
acacacgccttgtgtatatttacatttctgtagcattctctatggacacgctcatctagcatcatagacatcacagcatgcaagcaaacttcctaaccaaagtacctgtctcaattacataagccctggttggatttctaaattttctctataaataggaattcccttggcagacgtggtacttgaatggcccgtgtactgaggaaagcattgcaggaccctacagtgtttttcctcttctagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339578 - DNA, 927 bp, Homo sapiens
acacacgccttgtgtatatttacatttctgtagcattctctatggacacgctcatctagcatcatagacatcacagcatgcaagcaaacttcctaaccaaagtacctgtctcaattacataagccctggttggatttctaaattttctctataaataggaattcccttggcagacgtggtacttgaatggcccgtgtactgaggaaagcattgcaggaccctacagtgtttttcctcttctagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttagaaagtcctaaattctgaagtccgcgacctttcctccagccccccatctaaacaaggcaggctctgatgatggcctgctggaactctggactggcagatttctctgatggaaactcaaaaggtcccatggttcaaattgtcctgtgccccaaagcccatggatgtggctggggagcaggggagaaggaacaccttccaggacagtgacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339579 - DNA, 363 bp, Homo sapiens
  misc_feature (44)..(44): n is a, c, g, or t
  misc_feature (57)..(57): n is a, c, g, or t
  misc_feature (62)..(62): n is a, c, g, or t
tcctctctctcccctttctcaccccccatcactatcccgccacnatacttctaaggnaactncgagatcccctcacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339580 - DNA, 1693 bp, Homo sapiens
cagcaatcgcagccatggcgtcgttactgtggggaggcgacgcaggggcggcggagagcgagcggctgaacagccacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgcgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339581 - DNA, 1658 bp, Homo sapiens
aaaggaggaattgtagtgctacgctaaaataatagaaaaaagttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgcgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattct

SEQ ID NO: 339582 - DNA, 1831 bp, Homo sapiens
cagcaatcgcagccatggcgtcgttactgtggggaggcgacgcaggggcggcggagagcgagcggctgaacagccacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgcgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagaaaaaaaaaacaaaaaaaaaaagacaagaaaaaaaaaaaaaacaacaaaacaaagaagaagaaaaaaaaacagaaaggagcagcggagcgaggagggagaaccaaaaagaacagaggacaggaaggagcgagcgacagacgaccggagcgggggggggaccacgaggagagggcgcagaggagaagggaacacgcagagaggacagaggaaacagaaaaa

SEQ ID NO: 339583 - DNA, 402 bp, Homo sapiens
ctctgcctcccaggttcaagcgattctcctgcctcagcctcccgagtagctgggattcaccatggagtcttgaacccagattctgtgactgcttttgctctttttgtgttcatccaaacagtccctgtttatcctaagaggatgggagaaagagactgggagagaaggaaatccagtggcctccctccctgctagcagagcctggccctggcactgagccttcctcctctaccctctgctcctaatggtgagggtcccctagcagggcccttctgtccaggacacatgggccgcctgtcctcaccccagcctactgacctctctcctgggctggcctcagtgcccttgattgtgccggagagaggaagcgctggacagtcaggccaagctgctgtccccagg

SEQ ID NO: 339584 - DNA, 765 bp, Homo sapiens
gttcctgtgtcttcccgttgagttgctcgctccacggcatggaggactaggaatcaggagtcagtggccgtatgctggaggctggagccgcgggagcgcggctcgcctcgctgcggttgttggcagcgacggagataggagtgcggctggagcgatgtgccaggtggtgccagtgccagctaatcacctccctgttggcagcaccgtgaacactgtgcacctgtcttcagatggcacttaaagcagagaagcctgctgtgtggctgtgggagtcatcagagaggtggcagtggaggtttgttatcgacccaatcattacatcgctacccaagagttggaaacttcctgtgttgcccacgctggtctcaaactcctggactcatgggatcctcccaccttggcctcccaaagcagtggtattacaggcatgagccattgcactgggctcctgtttagttttaattttaaaacacctcaagagtcagataattcagggaaagaccatgcaaggctgttactgaagaaagtgctacgagtctgttctagacatggcttgcctagcactgagcatccttcctcacttctaagtgagaattttccagatctgtgcattggggtcccccaagaaagaggctcagtcctgatgtactgtttcctgtatactgcatgctcaccccccaaaaccacatggttaatccagatccagcccctgctttcttagttatgaggcttctcatggcaaagcaataaaaagcaagttttcaa

SEQ ID NO: 339585 - DNA, 736 bp, Homo sapiens
gttcctgtgtcttcccgttgagttgctcgctccacggcatggaggactaggaatcaggagtcagtggccgtatgctggaggctggagccgcgggagcgcggctcgcctcgctgcggttgttggcagcgacggagataggagtgcggctggagcgatgtgccaggtggtgccagtgccagctaatcacctccctgttggcagcaccgtgaacactgtgcacctgtcttcagatggcacttaaagcagagaagcctgctgtgtggctgtgggagtcatcagagaggtggcagtggaggtttgttatcgacccaatcattacatcgctacccaagaggatccagatgctcagtgtcatcttcgaagatgccaggtcacattggcaaaggccgcaagaactgatatgaaaaaccagatgcaatgaaaaccgtaactgtacttgagacagaactgcccaaggtcaagctggggcattctgtgttgaagaggaagatgccttggcagaagatcacttcatcatgaccagggcatcagaagaaggggtcgcagaatttattcatgatccaataagtatgcaccacctgttctggaagtgagttagcataaaacataagttcagtaagaatacaagaatgagtgagtgaattaagaaatgaatggattgggagttaccattggccacacaccgcttagacagtagaatatctcagccaggtagaaagaatggatcatggtggcc

SEQ ID NO: 339586 - DNA, 847 bp, Homo sapiens
ttggggtctggattacgtgatactctcagatgtgccaggtggtgccagtgccagctaatcacctccctgttggcagcaccgtgaacactgtgcacctgtcttcagatggcacttaaagcagagaagcctgctgtgtggctgtgggagtcatcagagaggtggcagtggaggtttgttatcgacccaatcattacatcgctacccaagcgttagctctgttcaacgcccttgtggagtccaggacttagagagaggatctccaagcagaagcccccagcccacgtgagaacagggagacccttgtgcccttaactgttttccatagtactgcccagccttgtacactctggcccaaatgttcctcacctttggaagacacagaacttctttcaaaaccattgaaatatcgagatcatttccgcagaaagaaaatgtaatttaagaggatccagatgctcagtgtcatcttcgaagatgccaggtcacattggcaaaggccgcaagaactgatatgaaaaaccagatgcaatgaaaaccgtaactgtacttgagacagaactgcccaaggtcaagctggggcattctgtgttgaagaggaagatgccttggcagaagatcacttcatcatgaccagggcatcagaagaaggggtcgcagaatttattcatgatccaataagtatgcaccacctgttctggaagtgagttagcataaaacataagttcagtaagaatacaagaatgagtgagtgaattaagaaatgaatggattgggagttaccattggccacacaccgcttagacagtagaatatctcagccaggtagaaagaatggatcatggtggcc

SEQ ID NO: 339587 - DNA, 972 bp, Homo sapiens
gttcctgtgtcttcccgttgagttgctcgctccacggcatggaggactaggaatcaggagtcagtggccgtatgctggaggctggagccgcgggagcgcggctcgcctcgctgcggttgttggcagcgacggagataggagtgcggctggagcgatgtgccaggtggtgccagtgccagctaatcacctccctgttggcagcaccgtgaacactgtgcacctgtcttcagatggcacttaaagcagagaagcctgctgtgtggctgtgggagtcatcagagaggtggcagtggaggtttgttatcgacccaatcattacatcgctacccaagcgttagctctgttcaacgcccttgtggagtccaggacttagagagaggatctccaagcagaagcccccagcccacgtgagaacagggagacccttgtgcccttaactgttttccatagtactgcccagccttgtacactctggcccaaatgttcctcacctttggaagacacagaacttctttcaaaaccattgaaatatcgagatcatttccgcagaaagaaaatgtaatttaagaggatccagatgctcagtgtcatcttcgaagatgccaggtcacattggcaaaggccgcaagaactgatatgaaaaaccagatgcaatgaaaaccgtaactgtacttgagacagaactgcccaaggtcaagctggggcattctgtgttgaagaggaagatgccttggcagaagatcacttcatcatgaccagggcatcagaagaaggggtcgcagaatttattcatgatccaataagtatgcaccacctgttctggaagtgagttagcataaaacataagttcagtaagaatacaagaatgagtgagtgaattaagaaatgaatggattgggagttaccattggccacacaccgcttagacagtagaatatctcagccaggtagaaagaatggatcatggtggcc

SEQ ID NO: 339588 - DNA, 237 bp, Homo sapiens
attgtagtttttaaacacattgacttagattagatgtccaatccttttttgttctttttaaatgttgataattgtatttgaaggactttgttttctgttttaatgttggtagttagcagcctgttgacctaatataaacctcatgtgagagattccttgtttcttgtaggtccctaaaagatgttggtgttacacatggcaagcattcaataaataaacatctgttaaatgaacaag

SEQ ID NO: 339589 - DNA, 874 bp, Homo sapiens
ttgaaaaagaagggaatagtacagctattaaagctgtactgaagggaatagtacagctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaacgtcatacaggctggacggaagggctcctgcattctggaggaatgttcaaagaacaaatgcaaaatcacagtggctggtacagggcaggggatggggcaagaggcagggccccttcaaaccatcggtccctggcagccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatttttaaaagataaacaaggaaccttaggacaccagccaggacagagcttcccaagacagcacaggtcccttctcctccaggcagcctaccctgcttgccaggcctgcctgtctcccaccctggacaggagccccaggggcacgggtggtcaggtccacgaaccacaaagtcaaagcaagctgcatccagtccccgttctactgcctagctttatgtgaccctggacaatccccttagccacaccgagtccttacctctgaaacggtgataaaaattctcacctcctagagttactatgaagattaactgagatcatgcacacacagcaacgtagaatgaaactagcacatggta

SEQ ID NO: 339590 - DNA, 743 bp, Homo sapiens
catttcaaatcaatacttgaaagacataggataattcatactgaagagaaaccatataagtgtaatgagtgtggcaagacctttaggcagaagtcaatccttacacgccatcatcgacttcatactggagagaaaccttacaagtgtaatgagtgtggcaagacctttagtcacaagtcatcccttacatgccatcatagacttcatactggagagaaaccctacaaatgtaatgagtgtggcaagacctttagtcacaagtcatcccttacatgccatcgtagacttcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcaaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtg

SEQ ID NO: 339591 - DNA, 335 bp, Homo sapiens
catggcaaccctgccttttgcaatactatcagcgccattcttccaaaaacacatgttcacttcatgtttctgagtcacattatgatcgttgcaatatttcatagtttttcattatcattatatcttttatgatgatctttgaggttactatcgtaagtgttttggagtgccaccaaccatacctatatgagacagtgaacgtaatcaataaatgttgtgtgtgttctgactgctacactgaccagctattccccatgtcttttcttctccttgggcctccctatttcctgagatacaacagtattacaattagttcaattaataactttttaatg

SEQ ID NO: 339592 - DNA, 491 bp, Homo sapiens
tgagtaaatgaatagtgcactataaataaccattaactacattacaaaaacaatgatgagcttgttaaaggcatttagatcttttcgctttttctcttttttaatctaatccttcacaaacaatgataatttatattaaattttgaccagaaaaatatataaattcaaacattaaatacatgcaagttgagcagctcaaattcgaaatccagattgctccaaaatccaaaactttttgagcactattaaggcattcaaaggatttggggatacttaactggtaagtaaaaagcaaatattccaagatccaaaaaattccaaaatcccaaacacttctgttcctaagcatttcagataagggatacttaccctataacaacataaacaactcaagcctaaactaatttgctccagctgaacacccctgaaatgagagagatgctcacagaacattggtcattcataacatatacatttaaggaaagttttga

SEQ ID NO: 339593 - DNA, 513 bp, Homo sapiens
ctaatttttgtatttttagtagagacgggattccaccatgttggccggcctgttcttggactcctgactcaggtgatccgcctgctttggcctcccaaagtgctgggattacaggtgtaagtcaccgcactcagccgatttaggcttttgaaaaagcaatacttgttgatttcttttagtgttagtttgccagttggtgtggaaaatgactgttgagtcaattttgaccacacatgatacttcacacatacagacaggaagtgttccaggtggctgaatacgtgaatgtcatatggcaagagagcaaacccgtgttccatagaagcatacctccaacagtaagcatttatatggcactggcttatagtcttccttttcattcactgtgctctcagtcaactcttctgtcaatttttttgagacagggtcttgctgtggtcacccaggctggagtgcagcggcacagatacttggcttactgcagtctcgacctcccaggctcaagcctcctgc

SEQ ID NO: 339594 - DNA, 799 bp, Homo sapiens
ctgcccagtctgcggtgctttgttctggcagcctgcactgactcacaaacccacttctgacctaggccctgactgggttcaagcatacacagcctggccagctcagccactgtccgcattcacagcctcctgcagcttccactgctcaggcatcctgatcctagccttcttagttggccattgctcaccagaccattttatatgggcaggaatgaggagacaaggaggccctcagggacacagttgcccctctgctgtcttaccctacctgtcttatcctctggaccatgcaaaatgtttatcttacgcagtcttttgttctttggtaaatgcatataacagacacatacttagtatccatgatgtcccagcagccccgcagctctgatcgtagtagaggtggtttaaagagaaatgcattaagtagagttgagtttgtttttcacaaatcaagacacatcccacttggggcaaagtcgtgacattcaggtgaacctgaaagttatagcttcttttatagccagttatccaagggctgaagccatcgagctgcctgccttctgagcacttgaaacaaaaaggattggaatgtttggtacaaaacccagcacttaaaacctatgaggctttcagctgtgactcttactgtctcgcctccatctgggaagttcattgatcttcaaaacctggcaggctcctcaggggagagaaggtttaagatggagcaggcagctcaaatccctattaggtccaagagccaagaggcgcaacgcacagctagttgggaacatatgaacac

SEQ ID NO: 339595 - DNA, 453 bp, Homo sapiens
atgcagtgagcagagttttcaaattgggaagtggtttttaatacttagaattctcgtttgccttcaattatgaaaatttttgtacagagctgctcaagaatgataatctggaaatttctttcagagagacagtgtggtgctgtgcccagagcaaggggttttggcagcggatagatccgggttcaaatactgggtccaccacctgctagttgtgggacttgaacaagttacttaatcttttggagcctcgggtttttcaccaatgacgtgagaaggataatggatcatagcacctgggagagggtggctattggccacatgagcttataaaaattgagcattgtgacttgtaatgtggtaaaatatacataacataaaatttaacatttgagtcacttttaagcatacaattcagtggcattcattgcaacgttttttaagatttccttattt

SEQ ID NO: 339596 - DNA, 552 bp, Homo sapiens
gtctagcttcctcctcgcctcctgccatgattgtaagtttcctgaggcctccccatccatgaggaactgctgttgtagcaggacgagccgcagacaaaactccttagacaccggattgaagaaggcagacttgcgtctcaaaagccgagctcaccgcgtgagcaattcccgtcccttttaagggcttacgactctaagggggtctgcgtgagagggtcgtgatcgattgagcaagccaggggtacctgactgggggctgcatgcaccgaattctatgaaagaaaaaaatcccattttcccagggagaaactgaaccattctgacctctggttatggctgtcatccaaacagtttatataacctgtctgggaaattgaagattgttcatatctaactctgcagttacaaaaggaccatgtctcatggaattatccacgctcagatcttccgcatggctcaaaaccatttttgggatatgagacagggtctcactatgttgctcaggctggtctcaaactcctggcctcaagcgatcctcccactttggactcc

SEQ ID NO: 339597 - DNA, 598 bp, Homo sapiens
ccacccacccagagtgctgggattacaggcgtgagccaccgtgcccggcaaaaaacatttttaaatacaaaaaaaggttgaaaaactcataggaggcattactgatttttctaggctgttgtagcaggacgagccgcagacaaaactccttagacaccggattgaagaaggcagacttgcgtctcaaaagccgagctcaccgcgtgagcaattcccgtcccttttaagggcttacgactctaagggggtctgcgtgagagggtcgtgatcgattgagcaagccaggggtacctgactgggggctgcatgcaccgaattctatgaaagaaaaaaatcccattttcccagggagaaactgaaccattctgacctctggttatggctgtcatccaaacagtttatataacctgtctgggaaattgaagattgttcatatctaactctgcagttacaaaaggaccatgtctcatggaattatccacgctcagatcttccgcatggctcaaaaccatttttgggatatgagacagggtctcactatgttgctcaggctggtctcaaactcctggcctcaagcgatcctcccactttggactcc

SEQ ID NO: 339598 - DNA, 429 bp, Homo sapiens
gtcgacccaaaccaggaggtatttgagtttccagacacggggcataagagtagagtcaatttgccaatcttgagcagggataaattgtcgtgcttgatgcataaggaaaggaggaggtttaagaaagccttgatggggtagtagagtggcattatagcccattgagaggtgattgttttgaggatggatttccaggctggaaaagaaatgagaggttctaaaaggtgggttaaagatttatatcctacatggaagtggtcatcaaaggaggagaggatagagtaagcttgagaggcagggagaaggagctttccatgatctaaaaaccagttgccttgagtgggaagtgactggtagtttaaggtttcagaaggagagtaataggagtgatagatgagaaggagaaatattggccactgggagcagata

SEQ ID NO: 339599 - DNA, 364 bp, Homo sapiens
ccatgttggctgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagagccacctaagctgaagattcccttgagaacaagtactgtccctagtttcccagtgctggaatatagaaaatggatggacaagtaaatcccactcagcacccatagtccaggcatggggacctcaacacacctgagc

SEQ ID NO: 339600 - DNA, 376 bp, Homo sapiens
ccatgttggctgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagatggggtcttcttatgttgcccaggttggtctcaaattcctaggctcaagtgattccgcccacctctgcctcccaaagtgctgg

SEQ ID NO: 339601 - DNA, 1065 bp, Homo sapiens
  misc_feature (42)..(42): n is a, c, g, or t
  misc_feature (45)..(45): n is a, c, g, or t
agtaggaagattattaataataataaaagaaaaaaagaaagntanctggaacgactctcttattttccaccgctacagcgcacctctttaagagagaacattcacaatggaaaacagcggcaagggttagaagacttttaaaaggaggctgttagtgcagcagtaaaatttggccagatgctcacaaaatgtctcggataacagctggactcataatgtcctcatcatgaccggaggggacaaggaagctgaattcctagaccagtctatctattcgaacacttcatcaattgtatctgcaaaaatattaatcaagacacaaagttcaaaccagtagagctgctggcttattctgggcctacagtcccatccttgaaattttactttctttttgttgagctccttgaatttgaggaaggccaaatgtgagagaggatgatgaagaaagggtaaaagttgcttgtagctgggcatgggaagctccaatgccaccacagagaaaagtctctaccagctcaggagcttggaaagggccctggtggaggagaatttgcataaggaaatcaccagctctagtacacttgtagcatgtgacaggaaaaatttgtcattggctatttatgaattaaatcttaataaaatccctaggtcttccctaaccaagcacaaatgtcttaagaggttacctataattttgaacatcctttcaggacattttctgcatagttaatgtgggcagttgtgtctaggcacaggacagatttacttctatgtcaatatttaaggcactgtatatggcacagagaccccattattcagtgaaaatatggcctattcaaggagatgaaagtttagtgagaatcttaactaggaagacaacaaagttactctatcaaagaaataatttaaatgactttgaagagaaaataagatttttttttaaatggaaagtttattttccaacctacaagacagttaaatagttagcatatctcttaaaccctaaattttaatttagcactcagagtgatgtcactgatagtctctagctcttaataaatgcag

SEQ ID NO: 339602 - DNA, 967 bp, Homo sapiens
  misc_feature (42)..(42): n is a, c, g, or t
  misc_feature (45)..(45): n is a, c, g, or t
agtaggaagattattaataataataaaagaaaaaaagaaagntanctggaacgactctcttattttccaccgctacagcatgctcacaaaatgtctcggataacagctggactcataatgtcctcatcatgaccggaggggacaaggaagctgaattcctagaccagtctatctattcgaacacttcatcaattgtatctgcaaaaatattaatcaagacacaaagttcaaaccagtagagctgctggcttattctgggcctacagtcccatccttgaaattttactttctttttgttgagctccttgaatttgaggaaggccaaatgtgagagaggatgatgaagaaagggtaaaagttgcttgtagctgggcatgggaagctccaatgccaccacagagaaaagtctctaccagctcaggagcttggaaagggccctggtggaggagaatttgcataaggaaatcaccagctctagtacacttgtagcatgtgacaggaaaaatttgtcattggctatttatgaattaaatcttaataaaatccctaggtcttccctaaccaagcacaaatgtcttaagaggttacctataattttgaacatcctttcaggacattttctgcatagttaatgtgggcagttgtgtctaggcacaggacagatttacttctatgtcaatatttaaggcactgtatatggcacagagaccccattattcagtgaaaatatggcctattcaaggagatgaaagtttagtgagaatcttaactaggaagacaacaaagttactctatcaaagaaataatttaaatgactttgaagagaaaataagatttttttttaaatggaaagtttattttccaacctacaagacagttaaatagttagcatatctcttaaaccctaaattttaatttagcactcagagtgatgtcactgatagtctctagctcttaataaatgcag

SEQ ID NO: 339603 - DNA, 373 bp, Homo sapiens
cctaacccttatactctcctatcctcaataccgccttccacaactcattattctgttattgacctcaaagatgccttctttaccatccccttacatccctcttcccagcccctttttgcctttacttggactgaccctgacacccaccagtcccaacaactcacctggaccgtcctgccctaaggtttcagagacagcccacactactttagccaggccctctcccgtgacctgctttcttttcgtccatttgtttcccatctcattcaatatgtggatgaccttcttctttgcagcccctcttaccaatcctcccagcaagacactatcctgcttcttcaacacctctactccaaggggtacagagtatccc

SEQ ID NO: 339604 - DNA, 500 bp, Homo sapiens
ttgtccctcaggtggactgtgccaggtactgggcttggtggagattatgtaggctggattgtgcctccatgcctgcctccttgattggtaccttagccaagggctcagactgcatgacagctgatggctctgaagagtgagcaaggggctgagaacttggcagagcctttcagctaggaaatggcagagctggaattccaagccaggtctgctgattctggagccagttgtcataaaccactgtggaggggagaaagctgtatgcctgtcagaagcatccggtgtagcctcgaccatcctgaggcttgtctttggaagtggtcctgcgaagacaaggtggctgtccatcaacaccgcaagaggaatcccccagtgggtggagggagagtgggcttgatgaccctgaagtatcccctccctgattccgagaccctgtcttacatgtgaggccatctgtcaaaacttaatgtcttaaaatatgacattttccctgtacaatc

SEQ ID NO: 339605 - DNA, 142 bp, Homo sapiens
ctgtcacgaccctcggcacttcacctgagttctaggagccactttggcagtcctctttctgtgccaccaatgggagtgaggggtgagcctggcagagacacacatgccaccctgggctttgtgacaaggcctggactctaat

SEQ ID NO: 339606 - DNA, 589 bp, Homo sapiens
ccagaaaggtcttttaagtcaaatgtatttcagatccaagagagcaagaacaatggtatactaggtcatatggtcttttggccctgccatttaaatataatatctgtacaaggaagtaactgcaggagtagtctgtatattcctgttggttggctggtgggaaggtagctaaccttttgtttctttctttttcagtacactgctttaataaatggtaacagtgctttaataagtcccctggccatcatcttacttatgatctctagatgaagaccactgtgtgaaactggtatcctaggaggttggagtgagcatgtatgagtgagtgtgtgtgtgtgtgtgtgtgtgtgtgtgtgtgtgttgcttgatttataaaccactgaagcccgatgaagtactagggtgaaaatcacctacgtttccagaggaaaaaaatgtcaccatcaattccaagagggacttgtaaacctgaaactaacagccaatggtttaatttttttaaggtagattttttttttaacatttctaggcttactatattctatctggaaaaatataaatttatgggcaaaaagaaaagctgagagtc

SEQ ID NO: 339607 - DNA, 499 bp, Homo sapiens
ttagacacccagggactaaaaaaaaatcatatttttatttaagctcagagataacaatgttagccaatttaaaaaaagacaatcaaaaaacatttaactaattagctgtcacatactagagaacacatttactctttattttaagaggacacagtacttgtatatcctcttgtattctatctggagcaattactgaccattaacataaaataacaggtgccatagcttaatagagaggttgcaacacagtggtaatggcatttctctaggtaacctggtattttaattcagttatagttaaatttaacctaggcaacaaagtcaataacggctaatgaattcaatggaaaaaaattgtattaaatgtgttttttaaaaaacatcacatgactaaacggtaagatgacactgtctattgaaatcagtacacttggtataccttgtgaagggtatacaacgaaacacttggggatcttcccataggagtcactacactatg

SEQ ID NO: 339608 - DNA, 747 bp, Homo sapiens
gcacagtcaagaccacagacacccgtggaggctcccccaagacatctgcttctctgggactggggacctcgctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctcccatggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggtgagttcctggacctcagggaggaagacggggatgaaaggaagagaggggccaattgggcaggggctcagtcctggcagcgctatatctcataagctttggttgcctgcatgatttttaccatatgcatctccctcctgtacttttacgtaagcagtattttctttacgtcgactctcattgttttacttgaataaacatctttcaaaaagaagcactataacgcgaccacaaatggaaaacccgcatcacttgtcagaaacagaaggcggaaagccaggacctccggcatgtcatcattcccttgctgcacactgtaatgtacgtgctcacc

SEQ ID NO: 339609 - DNA, 208 bp, Homo sapiens
tctggggctttgcagaacaggtctgtggagctaatggagctcataggagcttgacttggtcagggaggtcagggcggcttcgctgcggaagacttgtaggatggaaaggaattaaccaaggcaatagggaagagaaggtccagggcagagggaacaggttgtgccaaggccctggggcttgatgaaggccagagtggctggggtactg

SEQ ID NO: 339610 - DNA, 356 bp, Homo sapiens
tcaatccttcgtgcatgtgcgcatccactcaacatctcagtaatgaggacctactgtgtgccaggcactgtgctaagtgctggtgaggccctgctgtcatggggcctgcagtccaggactcaagttatcaccacacagatcaaagggaaaaccacgctgagttctggggctttgcagaacaggtctgtggagctaatggagctcataggagcttgacttggtcagggaggtcagggcggcttcgctgcggaagacttgtaggatggaaaggaattaaccaaggcaatagggaagagaaggtccagggcagaggaccaacgtcgacccggccgcgaatttagtagtagtagtcgacc

SEQ ID NO: 339611 - DNA, 596 bp, Homo sapiens
ttgaaaagacccctaaggaagctaccaaaacatcccagggggtctgaaataggaagccaaggcccacattgcagtggtaaaaatccaccaagcggtgactataggcaggtgggggagatgaagtgtttggaagatgttagaacctgctcattcaggagcagcagggcaagctgagctgagacacctgaaagtgagctactactgggacttgaaggtcccctgcgaaagtgcaaacacgctctggaaaaagcggggcctggggcctgcattcccaaacactaggatcctgtattaattttctacagccactataacaaattactacaaacttagtggcttaaaacaacacatataattacctcagtgctccttaggtcagaatgtgggttggctcagctggtttccctgctcctggttcatgaagctgaattcaaggtgacagcggactgggctcctatcaggaggttctggaaggatcctcttccaaacttattcatgttgctgaattcagttccctgcagctgtaggccggcggtccccatttctctgttggctgttagctaggggccaccgttagcaaccagtctctccctcca

SEQ ID NO: 339612 - DNA, 841 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttatgttttgttcccacaaaaacaaaaaaaaccgggctcttttcggggggaagggttgaatgggcttggctgctgttctgaccttttgttaagggaatcccggcctagggcgtaatcgacgtccaaag

SEQ ID NO: 339613 - DNA, 728 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttgtcttcacccatgtaataaaggtgttattgtttgttcccac

SEQ ID NO: 339614 - DNA, 747 bp, Homo sapiens
  misc_feature (506)..(506): n is a, c, g, or t
  misc_feature (747)..(747): n is a, c, g, or t
ccgcgacttcaccatcggctaggtgcgaggctgggtttacgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaaaaaaaaaaaaaaacaagaaaaaaaaagnaaaaataacaaacaacaaaataaaccccgcgcggcggccatctcaatgcaggcgcgcggccgccagaaacaacaaggtatcaatgaaccagaggcacgcatggggaacatagcacgtcctctcaacgacacccgaattttctggtcgtacacacggggggctacaacagagacagagggcagccccccaaaaggagaggaaccgcaaaacccacagaaaccaccgggtaccgctgttaaan

SEQ ID NO: 339615 - DNA, 796 bp, Homo sapiens
  misc_feature (756)..(756): n is a, c, g, or t
  misc_feature (766)..(767): n is a, c, g, or t
  misc_feature (770)..(770): n is a, c, g, or t
taaaaaaaaaacataggctagtggaggccgggtgttaatcggccgaggccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaatacaggtgttatggtttgttccacaaaaaaaaagaaaaaaaaaactnggggaatatnnttnggggggggaaaacaagggttatggaa

SEQ ID NO: 339616 - DNA, 1219 bp, Homo sapiens
  misc_feature (598)..(598): n is a, c, g, or t
ggctggtaccggcccgagatgtagggatattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccanaaaaaaaaaaaaaaaaacaacaacaaaaaacaacacacacgttgcgtgcggcgcgcgcacctcggggcccctcggaaaagcgcttttctagaaaccacatccgcggtggggggcggcgggggcccacagagggcaaagggaacacacggggccacaacaggtgtgttcccactagggaaaagactccgggcgggcacatggaaccaaaagcggcgggagggagatctctctacacacacagaataaaaaaaaaaacgccccgcgggggggggcaacaccgagacgcgttgtcttgggaggacacccaactcccccacaaagagcgggagggatctctcgagaggggtgactatatagcggggggagcactatataatacaaaagaggggggagagttccccaaagaggcgggaagacgcgcaaaatatatctccgaaaaatatatgaggccccccgggcagttccggggggggtcaacacgatatgcaaaaacgcgagaacacacaacaaacgacaaaccacacagcaaaaaaacaaccaaacaaaaaagaaaaaaatcaaagaacataagaagcaccaaacaaaaaaaagaaacgagcagacagaataacaaactgaaag

SEQ ID NO: 339617 - DNA, 1934 bp, Homo sapiens
ttttaaaaaaataattgcgcccccccgccccgtgccttggagatagtaagaattggagcagagcactgggacttcaattcacgcatggaaagagatctttgttagttggaggaaggagaacttgcctgagcttcgggcctttgttttgtttttgtgagagggacgtgtctcctaaatgaatgtttgctccagcgttgcacctcaaataagtcacctaaatatccacgccctctttatccaccccctctttactcgtgtgactagaatagttttcatttttcttctcaagggaatggctaaacagctcctatctgggcgtttgatggactgtcattcaagaatgagtgaagttgaggtgcctataagcaactcagaaattgttgtggccacgcttgggggaaatagagccctacactcaggtgatgagaggagacctcagaggtgaccgatccagggccttgctccctgcgccaccccagctcgtacctccagtggaacttggctgggcttatcaagagctcctttcattcattgcaacttcatttgttagaaagcttctctgtgtatttagtaggcattgtctccaacatgtaccactggtctggcttttgttaggcccattaatagtgtacatgtgacagcctttcaagtataggtgctccccggcttacggtggggtcgcatcccagtaaacacatcgttaaacctgaagtcgaaccatccgaagtcggagaccatctgtatttgaaaaaagtccctttgcattgcttgtaagagttctggttttcaaggtgagaaatctgtttgtgtgtttgtttgatcattctgcccaaaggagatgtggctttgggtccttttccccactcatcttccacaatgaattactttgtccatattaccctaaagaagtgacatccaagttggaatgtgatcttccgtatgtcgcctcccaaaaccccactaccatagcttcatgcttgtgttgacacagccacaatcacaactcaggtgtcagttctgagaccttcccatgcctgtcgccactcagcaagtgttcttcatgtgccctggcagttcgcattgtaaggagcagccaggttgttatggactgttgctagttaccacagagtagtgaattatattaaggattaattacagcagacaatgtgcacagtatcatcgagtgcagcgttctaaaaatgattctacacttttactttgaaaaattcttttttttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttgtcttcacccatgtaataaaggtgttcattgttttgttcccac

SEQ ID NO: 339618 - DNA, 883 bp, Homo sapiens
  misc_feature (860)..(860): n is a, c, g, or t
  misc_feature (878)..(878): n is a, c, g, or t
ctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttggttcaccatggtatagggggttattggtttttgtccccccatatattttgggggtgggtgtntccccctttttttttttncgctc

SEQ ID NO: 339619 - DNA, 1172 bp, Homo sapiens
  misc_feature (22)..(22): n is a, c, g, or t
cgcggcccgcgcgaactacggntgcgagaagagacagaagggtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttaaaggtggtttatgctttgcttcccacaaaaaaaaaaaaaaaaaaaacaaaaaaaaaacgtgtgtgtctgcggccgcgcctcatgcggcgccccttggcgaagaaaagcttgtcttaaaagaccaattcggttgtgggggcgccgcgggcccagaatagaggtataaggggaaacagtgggcccacaagcgcgggtttcccatagagaaaactcgcgggcaccgagcacctgagggcggggggatttcccccaccaaatttaaaaaacgcgcccgggggggaaagacgaggagaggcggtcagtgaggacaaccacgccaaagagggagaggcttcggaaggggacataacggggggctcataaccacaaccggggaggccgacaggcagagcaggagaatcaaaatataaacgcccccgaccggggagaaaagaaacaacaaaagagaagaacgaaacagcgaagcatataagcacaagcgcgacaaacaaaacgctaaaaaacacacagaaagacaagaactaaggaacaaacacaaaaagcaagaaaaaagtccaaaacgaaaaaagtagaacagaaaaaacacaaaagagacgaacagacgatgacacaaagagagaccgacacaacgaggatataatagacaacaagtcgtaaaattaaacacagaacaaaaacacaacacaaacaacaaaacaaagaatacagagga

SEQ ID NO: 339620 - DNA, 936 bp, Homo sapiens
cccaggtagaccacgtcgggttatcaagacagcctgaccaacacggagaaacctgtctttactaaaaacacaaaattagccaggcatggtggtgcacgcctgtaatcccagcactttaggaagctgaggcagcgaggatctcttgagcccaagagttcacgaccaccccggaacaccaggtagacctaacaagattggcccccgccgcatccacacagtccgtgtgcggggaggtaacaagaaataccgtgccctgaggttggagtggggaatttctcctggggctcagagtgttgtactcggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttaaaaaaaacacaaaaatacaacaaacaacaaacaacatccgcggggctctatatgtggggggggggcgaaacaagggggttactgcacaatgcgccctggttcaaatacgtgtttctcggcgacccacgttcttggtacaaagggggacaaattggggggcacacttaggggacgcatcataattctcaaaggccgggttcacctgct

SEQ ID NO: 339621 - DNA, 968 bp, Homo sapiens
  misc_feature (842)..(842): n is a, c, g, or t
ctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgttatgttgtcccaaaaaaanaaaaaaaatttgggcgccgccaaagttaacatgtttgggccgcccgaaggaacgcacgccagaacgccaagcggtccccaaaccggcgcggcaacccggtggttgttcacgccacccccctcccgg

SEQ ID NO: 339622 - DNA, 1092 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339623 - DNA, 780 bp, Homo sapiens
  misc_feature (9)..(10): n is a, c, g, or t
  misc_feature (12)..(12): n is a, c, g, or t
  misc_feature (742)..(742): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacaaaaagtcgancggccgcgaatttagtagtagtagtagtatgcggccgc

SEQ ID NO: 339624 - DNA, 1142 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccatattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgagggggtatcccaaccttggggttcagtaatattgtgctggctgagtcatgattagaatctcaggctatattgcttataaaaaattttaaggatcttgtacccattgtaagattaacagtgatttctgccttgaaaagtctc

SEQ ID NO: 339625 - DNA, 1080 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaaaaaaaaaaaaaaaaaaaaaaaaaaaaaaaaaaaaaaaaaaaaagtgtgtgtgggggcgcggcgccgggcgccccgggagaaaggttttttaaccccctctccggggggggggcgggggcgcccgagtgggtctacgtggaacactgtgggccatagcggtgtccagagaaaaccccgcgcaataggacagcggcggtggttcctcaccaacaaaaaaagccgcgggggcgacacgcgcggctcgtgaacaaaacccagggggcgctccggaggcaacacggcgcccatcccacaggggccccaggagcgcgaaataaagtggcgcggcggggag

SEQ ID NO: 339626 - DNA, 1054 bp, Homo sapiens
  misc_feature (9)..(10): n is a, c, g, or t
  misc_feature (12)..(12): n is a, c, g, or t
  misc_feature (842)..(842): n is a, c, g, or t
  misc_feature (851)..(851): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaaaaaaaaaaaaaattgttgggggcggctgtgggccctgggaaaaagtttttaaaaaccattgcgctgggggggcgcgggggcccagaagagggtagngtagaacangtgggccaaacggtggtgtccaaagaggagagaacccggggccaagaacaaaggggcgggggattctctcccccaataaaaaaacggcccgggggggaaaaccccggccgtcgtcgtgagaccaatccccgaatgaggagccggagagggccaaagcgggatctctacaccaagagaccacacggaccccgaattaaatcacg

SEQ ID NO: 339627 - DNA, 1080 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacaaaaaaagaaaaaaaaaaaaaaaaaaaaaaaaaaaaaaaaacaaacaaagaacaaaaaaaaaaaaaataaaaaaaaaaaaaaaaaagaaaaaaaaagaaaaaaaaaaaacaagaaggggggggggggggggtgttgccccggggagatggggtgggaaacaagattctcacgatgagggagatggtgttgacacacccccgtcgtgtttttaaaacaaacacaaagataaacaagatgtagggtagaacaccctcgcacgagtggagtgagcgtagttgtttttagtcaactcgtgtcggaaaaagggagaatcaaaatacgtgtgtgagcggcgtttggcagtaaata

SEQ ID NO: 339628 - DNA, 1117 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacaaaaaaagaaaaaaaaaaaaaaaaaaaaaaaaaaaaaaaaacaaacaaagaacaaaaaaaaaaaaaataaaaaaaaaaaacgggggggggcgcgcgcgcggcgaccccaaaaaagccttaacacaaaaaccaagagagagaggaggaggaggcgggcccacaggggagagaagagcagacacagcggggaccacagggcgtccccaagagacaccgcggggcggaaaaaaaagggggggaggacccaccaaaaaaaaaacggcgcgggggagacacagaggctcgaaagaaacaaaaacaaaagaggaacaaagaggagccttaaagggagtaaacaagagaaggagcaaaggaggcacaaaacaatacccccaagagggggggga

SEQ ID NO: 339629 - DNA, 1032 bp, Homo sapiens
  misc_feature (9)..(10): n is a, c, g, or t
  misc_feature (12)..(12): n is a, c, g, or t
  misc_feature (815)..(815): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaaaaaaaaaaaaaaaaaaaaaaaaaaaaaaaaaaaaaaaaaaaaaaaaaaaaaaaaaaaaaaaaccttgtnggccgcttgggccacagcgattttaaattggagcaagtttttgcaggcggccgaatttcgggctaatttggccaattcgccctatagggggccttataacattcaattggccgtcgtttaacacggttgtaactgggaaaaccctggggatacccatctaattcgctttgaacaaatccccctttcaccagctgttgaactgaattgtgagggttat

SEQ ID NO: 339630 - DNA, 1384 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaacaaaaaaaaaaaaaaaaaaaactttttgcggccgcgccctgggcccctccgagagaaggccttttctgtagaccccccttctgcgttgtgggcgcgccgcggggcccccagttggggcttacggtgtgcacccttggccccctatacgcgtgtttcccccgtgggggggagaaccccgctgcgccccagtgaaccctcagcggcgcgtggggcattctctcgccccccatatttacaaaaaacaccgcccggcgggggggcaaaacacccgagagcggcgttttctctgcggaacaccaacaatctctcccagagaagtggagcactttctctgagagagcggcccacatataacacggggggaatctctatctatcaccacacgagagggagctctccacacaagcgcgaagagcgccctcaagcatattatcctcccaaatatttttagccgccgcccccgcggctctcggtgggggagtacacacaacaactgccaccaatgaatcacgtccgccaaccaccgcctcccaccaagcagccctaagccgcacaacgcgaccaaaccacaccaccagaccacccaccagccccacacccaacacgaacagcagccgcaccacgcactacagcacaacccaccacact

SEQ ID NO: 339631 - DNA, 1352 bp, Homo sapiens
  misc_feature (9)..(10): n is a, c, g, or t
  misc_feature (12)..(12): n is a, c, g, or t
  misc_feature (731)..(731): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccanaaaaaaaaaaaaaaaaacaacaacaaaaaacaacacacacgttgcgtgcggcgcgcgcacctcggggcccctcggaaaagcgcttttctagaaaccacatccgcggtggggggcggcgggggcccacagagggcaaagggaacacacggggccacaacaggtgtgttcccactagggaaaagactccgggcgggcacatggaaccaaaagcggcgggagggagatctctctacacacacagaataaaaaaaaaaacgccccgcgggggggggcaacaccgagacgcgttgtcttgggaggacacccaactcccccacaaagagcgggagggatctctcgagaggggtgactatatagcggggggagcactatataatacaaaagaggggggagagttccccaaagaggcgggaagacgcgcaaaatatatctccgaaaaatatatgaggccccccgggcagttccggggggggtcaacacgatatgcaaaaacgcgagaacacacaacaaacgacaaaccacacagcaaaaaaacaaccaaacaaaaaagaaaaaaatcaaagaacataagaagcaccaaacaaaaaaaagaaacgagcagacagaataacaaactgaaag

SEQ ID NO: 339632 - DNA, 898 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaatacaggtgttatggtttgttccacaaaaaaaaaaggggcggtaaagtatctgggggcagttaaggtacagtttggaaagggccatggggataagagagggggttaaagtgcggaaagtctggtttggaggacttttggggctatggcacactaggtaagcggataatgtggtagttggggatgggataaaaagc

SEQ ID NO: 339633 - DNA, 1203 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttggtcttcacccatgtaaaacaaacaacaaaaacacaaaaaaaaaaaaaccttttgcggccgcctggggccccgagagaaggtgtttttttaccaccctcttcgtttggccccggggccccccaggttggtttcgtgtcaccacggggccataagggggtcccaagggaaacccgcgccatgacacacggcgttgggttctctcccccaaaataaaaaaagcgcgcggcggaacccggggttcgtggttccccaacgacagggcaaatgggggccgagctggcgaacctttctcccgaggagcattggggcgccagggttaatctgatgagcaacgccggtccgcgctctaaaaactgcggttaatactagcgcgatcacacaatgatcatacagtagatgacaacaacgactataaccatacacaatattgtacaaacacaatacacgaagacactacaacgcgtactaatctaaccactacactcaagccgtgactacactaacagcacgtccc

SEQ ID NO: 339634 - DNA, 1136 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttggtcttcacccatgtaataaaggtgtctatgggttggttcgccacaaaaaagaaagaacagacagaaacaataagaaaaaagaggcgggacaaaggacaaaataaagaagacaggaagaagaaaagtggcggcggggagggacggggaccgagaggaagcggccgcacagcacgcaacgccagcgggggacgcagggaccgaccacgaagcgtggacagaaaacacacgggacagataggaagacaaaccagaacagagagcacgcgggccgcgcaaaacacgaggtcgcgggagactcccctcaaagaataaaagaaacacggaggggcggggccacaagcccgcttctgcaaaacaaacacaccgcgagaaggacgtcaaggcaggaccacaggggggcacccaaaacgggacgcggaccacacacagcgacccgagaacaaaagac

SEQ ID NO: 339635 - DNA, 1011 bp, Homo sapiens
  misc_feature (9)..(10): n is a, c, g, or t
  misc_feature (12)..(12): n is a, c, g, or t
  misc_feature (799)..(799): n is a, c, g, or t
  misc_feature (808)..(808): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttaaaaaaaaaaaaaaaaaaaaaaaaaaaattgttgggggcggctgtgggccctgggaaaaagtttttaaaaaccattgcgctgggggggcgcgggggcccagaagagggtagngtagaacangtgggccaaacggtggtgtccaaagaggagagaacccggggccaagaacaaaggggcgggggattctctcccccaataaaaaaacggcccgggggggaaaaccccggccgtcgtcgtgagaccaatccccgaatgaggagccggagagggccaaagcgggatctctacaccaagagaccacacggaccccgaattaaatcacg

SEQ ID NO: 339636 - DNA, 931 bp, Homo sapiens
  misc_feature (9)..(10): n is a, c, g, or t
  misc_feature (12)..(12): n is a, c, g, or t
  misc_feature (728)..(728): n is a, c, g, or t
  misc_feature (732)..(733): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttggtcttcacccatgtaaaacaaacaacaaaaacacaaacnaaannttaaaaaaaaaaaaaaaaaaaaaaacaaaaaagagggggggaggagacgaggggccccagggaagagagggttagataaaagaacacaagagggtgaggagagaggcgggggacccgaaaggaggcgcacaagagaaaagcgtgggcaaaaagagggggccaacgagggaggaacccgcgggggacacaccggaaaga

SEQ ID NO: 339637 - DNA, 1058 bp, Homo sapiens
  misc_feature (9)..(10): n is a, c, g, or t
  misc_feature (12)..(12): n is a, c, g, or t
  misc_feature (717)..(717): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttaaaggtgtttatgtttgttcccacaaaanaaaaaaaaaaaaaaaaaaaaaaaaactttttgggcggccttgggcccaagaaaaaagtttttaaaacaatccggtggggcgcgcgcgggccccaagttgggatagtgcgaccacgtgggcaaaagaggggggtacccaaaggggaaactccgggcgacagtagatcaagcgtcgctggggattcttcaccaaatataaaaaaaccgcgccggggcggggcaacccagagcgggtctggaacaaatcccagaggggagaggtccgagagaggcaataagggggctctatcaaccagggggcccaagggagagccagatataaattaagccccgccatggacc

SEQ ID NO: 339638 - DNA, 1099 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgagggggtatcccaaccttggggttcagtaatattgtgctggctgagtcatgattagaatctcaggctatattgcttataaaaaattttaaggatcttgtacccattgtaagattaacagtgatttctgccttgaaaagtctc

SEQ ID NO: 339639 - DNA, 1111 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttaaaaaaaaaaaaaaaaaaaaaaaaaaaaaaaaaaaaacaaaaaaagaaaaaaaaaaaaaaaaaaaaaaaaaaaaaaaaacaaacaaagaacaaaaaaaaaaaaaataaaaaaaaaaaacgggggggggcgcgcgcgcggcgaccccaaaaaagccttaacacaaaaaccaagagagagaggaggaggaggcgggcccacaggggagagaagagcagacacagcggggaccacagggcgtccccaagagacaccgcggggcggaaaaaaaagggggggaggacccaccaaaaaaaaaacggcgcgggggagacacagaggctcgaaagaaacaaaaacaaaagaggaacaaagaggagccttaaagggagtaaacaagagaaggagcaaaggaggcacaaaacaatacccccaagagggggggga

SEQ ID NO: 339640 - DNA, 1302 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339641 - DNA, 752 bp, Homo sapiens
  misc_feature (9)..(10): n is a, c, g, or t
  misc_feature (12)..(12): n is a, c, g, or t
  misc_feature (511)..(511): n is a, c, g, or t
  misc_feature (752)..(752): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaaaaaaaaaaaaaaacaagaaaaaaaaagnaaaaataacaaacaacaaaataaaccccgcgcggcggccatctcaatgcaggcgcgcggccgccagaaacaacaaggtatcaatgaaccagaggcacgcatggggaacatagcacgtcctctcaacgacacccgaattttctggtcgtacacacggggggctacaacagagacagagggcagccccccaaaaggagaggaaccgcaaaacccacagaaaccaccgggtaccgctgttaaan

SEQ ID NO: 339642 - DNA, 828 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339643 - DNA, 1039 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacaggactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339644 - DNA, 1824 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagctcagcctcccaagaagctgggattacaggcgtgtgccatcacacccggctgcttctgtatttttagtagagacggggtttcaccatgttggccaggctggtctcaaattcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339645 - DNA, 2007 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagctcagcctcccaagaagctgggattacaggcgtgtgccatcacacccggctgcttctgtatttttagtagagacggggtttcaccatgttggccaggctggtctcaaattcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacaggactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339646 - DNA, 783 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttgtcttcacccatgtaataaaggtgttattgtttgttcccacaaaaaaaaacaagaacgacacacacaatcaaaaaagccgcgggcaatgttgtttc

SEQ ID NO: 339647 - DNA, 1008 bp, Homo sapiens
gcggccgctactactactaaattgggggcgttcggacgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacaggactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaccaaaaaacaaaaaacaaaaacaaagggggggcccccacaaaagtttcccccgaggggggccccacaatttaaccgtaccccgcaggtatttcttgtgtacacacaagaggggaccccctaattagaggaggcacagtattttatgacgaatagcgacacttggcggccgcactgtgtttacacaaggtctgagagcagtgaggacacaaacggggctatgcgatgtggggaacattgtgtgttcgacaaggagaacccataaactccgaggggagagggcacacaactgggtggacacaacatactaccca

SEQ ID NO: 339648 - DNA, 405 bp, Homo sapiens
agagagagagagagagagagagagagagagagagagagagagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggagtggggaatttctcctggggctcagagtgttgtactcgtaaaacaaggatcatcgatgttgtctacaatgcatctaataacgagctggttcgtaccaagacctgggaaagatttcatctatcacgaagaccacctaacgcagttgatcgtcactatgcctcccggaccaagaggagcaa

SEQ ID NO: 339649 - DNA, 1071 bp, Homo sapiens
  misc_feature (9)..(10): n is a, c, g, or t
  misc_feature (12)..(12): n is a, c, g, or t
  misc_feature (859)..(859): n is a, c, g, or t
  misc_feature (868)..(868): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaattgttgggggcggctgtgggccctgggaaaaagtttttaaaaaccattgcgctgggggggcgcgggggcccagaagagggtagngtagaacangtgggccaaacggtggtgtccaaagaggagagaacccggggccaagaacaaaggggcgggggattctctcccccaataaaaaaacggcccgggggggaaaaccccggccgtcgtcgtgagaccaatccccgaatgaggagccggagagggccaaagcgggatctctacaccaagagaccacacggaccccgaattaaatcacg

SEQ ID NO: 339650 - DNA, 1126 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgagggggtatcccaaccttggggttcagtaatattgtgctggctgagtcatgattagaatctcaggctatattgcttataaaaaattttaaggatcttgtacccattgtaagattaacagtgatttctgccttgaaaagtctc

SEQ ID NO: 339651 - DNA, 1278 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaagaaagaaggaggaggcgacgcaacgactaaaagaaagactcaatcagagcgcgaggagaccacaagacaatgctacgacgcacaacacagcaaaagtctacacaaagaaaaagaaggatcacataacaaaaaagcgcgcgaaataaacagaagagaggacgggagggacaaaaacacaaacaaaagcgataaacaacaaaccacgcaacacaaagaagagaaataaagaaagacagaacaagcacaacaaaataaatgggcaagagcgagcaacaaaaaaagagcacaaaacacaacaaaaagaaaaatcacacacctaacgaagaagccacaccaaccaacaactagaatatgtagagcgagaaaaccaaacagacagaatacgagccaaaagaaaagagcacggcaaaaaaaagtagaaacaaaaaaaccacgggaggaaaaaaaccgacacgc

SEQ ID NO: 339652 - DNA, 988 bp, Homo sapiens
  misc_feature (9)..(10): n is a, c, g, or t
  misc_feature (12)..(12): n is a, c, g, or t
  misc_feature (805)..(805): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttgtcttcacccatgtaataaaggtgttcattgttttgttcccacaaaaaaacaaaaaaaacaacaaacaaaacaacaaccacaaaaacacaaacacacacaacaaacaccaacgaaaanacaaagggaaagaaaaaagcaacaatcgaggagaacaggagaaaaaaagacacaaaaaagggaaacaagaggacaccaaagagaacaacaaaagccagaaaagaagaaagaacggcacgacgggaccgcgagcgacaaacaagccgcccgagcacgaacaggagccgcggcaacgaaacgaaa

SEQ ID NO: 339653 - DNA, 791 bp, Homo sapiens
  misc_feature (9)..(10): n is a, c, g, or t
  misc_feature (12)..(12): n is a, c, g, or t
  misc_feature (751)..(751): n is a, c, g, or t
  misc_feature (761)..(762): n is a, c, g, or t
  misc_feature (765)..(765): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaatacaggtgttatggtttgttccacaaaaaaaaagaaaaaaaaaactnggggaatatnnttnggggggggaaaacaagggttatggaa

SEQ ID NO: 339654 - DNA, 1080 bp, Homo sapiens
  misc_feature (9)..(10): n is a, c, g, or t
  misc_feature (12)..(12): n is a, c, g, or t
  misc_feature (810)..(810): n is a, c, g, or t
  misc_feature (845)..(845): n is a, c, g, or t
  misc_feature (853)..(853): n is a, c, g, or t
  misc_feature (1080)..(1080): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgaaaaaaaaaaaaaaaaaaaaaaaaaaaaaagtgttgggggcggccctggggcccggaaaaagtttttaaacaaccatctcgggtggggggggcggggggccccagtggngtaaggggaaactggggccaagagcgggtgtcccnaagagganaaccccggggccaagagcacgagggggcggggggttctcctcacccaatttaaaaaaaagcgcacgccggggggcgaagaccgccgaagggttcctgggtaacaaaatttccacaagaggggggagtccgggaaagggcacaagaggggggttcctaatccacacggggggatctcccaaggaggaaaacccgataattccaatttaaggcccccgggctggtgaan

SEQ ID NO: 339655 - DNA, 1311 bp, Homo sapiens
  misc_feature (9)..(10): n is a, c, g, or t
  misc_feature (12)..(12): n is a, c, g, or t
  misc_feature (890)..(890): n is a, c, g, or t
  misc_feature (901)..(901): n is a, c, g, or t
  misc_feature (907)..(907): n is a, c, g, or t
  misc_feature (933)..(933): n is a, c, g, or t
  misc_feature (937)..(937): n is a, c, g, or t
  misc_feature (943)..(943): n is a, c, g, or t
  misc_feature (954)..(955): n is a, c, g, or t
  misc_feature (961)..(961): n is a, c, g, or t
  misc_feature (983)..(983): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttggcccccttggcccaattgaattttaaattcgacaaagtttatccttgcggccaaatttgggcctaattggccaaattccccttatagggagtcgttttnaaattaattgncccgtnttttaaaaactttggaattggaaaancctngggttncccaaattaanncccttngaaaaaaatccccttttcccanttggcttaattacaaaaaggccctaaccaacggcctttccaaaaagttggccacctctatggcaaaaggaaaatttgaaccttaaataatttgtaaaatttcggtaaaattttgtaaaatcagttatttttaaacaatatggccaaattggaaaaatcctttaaatcaaagaattccccgaatagggttaaggtttcccaattggaaaaagatcccattttaaaaacgggcttccaacttaaagggcaaaaaaccttttaagggcaatggccattggtgaccatcccctaaaaaatttttgggtcaaggcccaccttaacggcctggg

SEQ ID NO: 339656 - DNA, 1401 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttaaaggtggtttatgctttgcttcccacaaaaaaaaaaaaaaaaaaaacaaaaaaaaaacgtgtgtgtctgcggccgcgcctcatgcggcgccccttggcgaagaaaagcttgtcttaaaagaccaattcggttgtgggggcgccgcgggcccagaatagaggtataaggggaaacagtgggcccacaagcgcgggtttcccatagagaaaactcgcgggcaccgagcacctgagggcggggggatttcccccaccaaatttaaaaaacgcgcccgggggggaaagacgaggagaggcggtcagtgaggacaaccacgccaaagagggagaggcttcggaaggggacataacggggggctcataaccacaaccggggaggccgacaggcagagcaggagaatcaaaatataaacgcccccgaccggggagaaaagaaacaacaaaagagaagaacgaaacagcgaagcatataagcacaagcgcgacaaacaaaacgctaaaaaacacacagaaagacaagaactaaggaacaaacacaaaaagcaagaaaaaagtccaaaacgaaaaaagtagaacagaaaaaacacaaaagagacgaacagacgatgacacaaagagagaccgacacaacgaggatataatagacaacaagtcgtaaaattaaacacagaacaaaaacacaacacaaacaacaaaacaaagaatacagagga

SEQ ID NO: 339657 - DNA, 1058 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttatgtttgttcccccaaaaaaaaaaaaaaaaaaaaaaaaaaaaaatgtgttgggggggctgggccttgaaaaggtttttaaaaaaatttggttgttgggggcgggggccccaagcataggtatcgggtgaaaacggggcaaacaggggtgtgttcccaaaggaagacgctcggcgatcctgagaacaagcgccgtggggattccttccccacatataaaaaccaggcccggggggccaacacggaaggtgttgctgcgaaaaaaacttccaagaagggggagtcaggagggccaagagaggggcatcactaccaacggggaagtcccaaagagaagctcgcgaaatatacaaattaaccacccgcaccggg

SEQ ID NO: 339658 - DNA, 1059 bp, Homo sapiens
  misc_feature (9)..(10): n is a, c, g, or t
  misc_feature (12)..(12): n is a, c, g, or t
  misc_feature (717)..(717): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttaaaggtgtttatgtttgttcccacaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattataaataaaaaaatataaaatatatttaataataaatttataaaaaatttaatataaaataataaattttataacttttttatattttattaatttttttataaattatattttattaattttaatttttattatataatatttatttttttataatataattttatttttattttatattattaatattttatatatattaattttaatttaaat

SEQ ID NO: 339659 - DNA, 1342 bp, Homo sapiens
  misc_feature (9)..(10): n is a, c, g, or t
  misc_feature (12)..(12): n is a, c, g, or t
  misc_feature (921)..(921): n is a, c, g, or t
  misc_feature (932)..(932): n is a, c, g, or t
  misc_feature (938)..(938): n is a, c, g, or t
  misc_feature (964)..(964): n is a, c, g, or t
  misc_feature (968)..(968): n is a, c, g, or t
  misc_feature (974)..(974): n is a, c, g, or t
  misc_feature (985)..(986): n is a, c, g, or t
  misc_feature (992)..(992): n is a, c, g, or t
  misc_feature (1014)..(1014): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttaaaggtgtttattgttttgttcccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttggcccccttggcccaattgaattttaaattcgacaaagtttatccttgcggccaaatttgggcctaattggccaaattccccttatagggagtcgttttnaaattaattgncccgtnttttaaaaactttggaattggaaaancctngggttncccaaattaanncccttngaaaaaaatccccttttcccanttggcttaattacaaaaaggccctaaccaacggcctttccaaaaagttggccacctctatggcaaaaggaaaatttgaaccttaaataatttgtaaaatttcggtaaaattttgtaaaatcagttatttttaaacaatatggccaaattggaaaaatcctttaaatcaaagaattccccgaatagggttaaggtttcccaattggaaaaagatcccattttaaaaacgggcttccaacttaaagggcaaaaaaccttttaagggcaatggccattggtgaccatcccctaaaaaatttttgggtcaaggcccaccttaacggcctggg

SEQ ID NO: 339660 - DNA, 885 bp, Homo sapiens
  misc_feature (24)..(24): n is a, c, g, or t
aatcagctcggtacccccacttanccgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339661 - DNA, 1614 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagctcagcctcccaagaagctgggattacaggcgtgtgccatcacacccggctgcttctgtatttttagtagagacggggtttcaccatgttggccaggctggtctcaaattcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339662 - DNA, 1538 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339663 - DNA, 706 bp, Homo sapiens
  misc_feature (9)..(10): n is a, c, g, or t
  misc_feature (12)..(12): n is a, c, g, or t
  misc_feature (558)..(558): n is a, c, g, or t
  misc_feature (564)..(564): n is a, c, g, or t
  misc_feature (574)..(574): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaaaaaaaaaaaaactcgagactagttctctctctcggggggttggcttaggcgcaaacggggaagcggagccaaatngccagnggccggagcngggttggtcgcaaaacttttgtgaccccggggagacccttcgagaaatctcgtctcgaccaagagctgaagctgatcggcgagtatgggcccgggaacaaacgtgaggtcgggggggtcaatttcccctggc

SEQ ID NO: 339664 - DNA, 1748 bp, Homo sapiens
  misc_feature (9)..(10): n is a, c, g, or t
  misc_feature (12)..(12): n is a, c, g, or t
tgcttccgnnanaaccttacggctaggtacgaggctgggtggtgcgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaaaaaaaaaaaaaaaaaaaaaaaaaaaaaaaaaaaaaaaaaaaaaaaaaaaaaaaaaaaaaaaaacaaaaaaaaaaaaaaaaaacgggggggcggccagaggagcacaaaagagaacaacaacacatagggagggggagggggagcacacaagagaaagagaaaaaggggcaaacagaggacacacggacaccccggggacaaaaaaagggggggaagaacacaaaaaaaaacaccccggaaaaaaaaagagagaaaaaaaacatccaaaaagagaaaagagaaaaaaaggggaaaaaaaaaaagagaaacaagagggggcaagaaaaaaaaacccaatgaggtgac

SEQ ID NO: 339665 - DNA, 190 bp, Homo sapiens
aatgcaaaagttttagagataatgagcttagagaaattacatggggggaagaaatacctggatcatatttgaaagcatttgtcttgaattctgctcatctaaatgagagctctctttctacctgtgtcatttaaaaaacaatttcaatatcctcctacctgctaccccagcctgaagcagggactaatga

SEQ ID NO: 339666 - DNA, 386 bp, Homo sapiens
gcccctacccagaatacatcaattcattagtaaacacatcatgtatgaagaatgtctatttcttaaaacagagaattgcagcatgtctgtattctaaagagtctctattctttctgtagtagtgtaagttagttctgtagtggtgtaagtggtttcaaattctcagttcctcaataaaggtgtgtgtattcacatgttttaaagcatattacatttgtatttgtgacacatggaaaatagggagttgaaggtaaggaaaagagaatttggactggtcaaaattgtgaacaatatcatttggtgtaacaaaagacctaaaaatactttggtgctttatcattaaaaaaacagagttctcaggccaggtgctgtggctcacgtctgta

SEQ ID NO: 339667 - DNA, 417 bp, Homo sapiens
tctggagtaacgggcaaatgtaaaaaaacaaactcttgccactgcctgtcatgatattgttcttcatatgctgctcaacgacagcaacaggtgtccctttatattttcttaagtgtcacccatatagctattctcactgtcctgtggacattactagagtgtttggtggaaatgcttccctagctcaccctgcttacaagctccaaggctcttccctttacaacagtcgtaaggccagactggaagaaagcccccatgaagcccatgtttcagtatcatgttggcaccgtctatgagcaaccccatgactcagcaagatttctcgcactctccttggtaactcaagtcccacagattgctgctgtggttgtatgagtgccccaggagcctcttgagtgtggtgggcattgtgtgatg

SEQ ID NO: 339668 - DNA, 337 bp, Homo sapiens
catgctgtaggccagcggctgttggggatcgagtagggttccccagaaaggagggagctgaggctcacaaagaagcgaggccctggtatctgatcagttcgtggagacgtgggagagcctgcttgtcatctggaacagtttagcagcctcggcctccctgtctctcccagccctggggagtaccggtagcctctggccgtttcattatattgttgttaaggcccttctccttgtcagtttaccaggtttgaccgcccagccctggtctctgcgtggaaacccccgggggcccctctccttccagtaggcaacatcttcagagccaaaccctggccta

SEQ ID NO: 339669 - DNA, 646 bp, Homo sapiens
gtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtg

SEQ ID NO: 339670 - DNA, 666 bp, Homo sapiens
tggtcttctcacagcagtcattccggacagaagtcagcaaacttttctgtaaagggctagatagttaaatatgtttggctttatgggccatgcggtctctgtcacaactccgcaacaaaagcagccagaggcagttcataaacaaatgggcatgactgtgatccaataaaactctatttacaagaagatgtgacgagctggatttggttctcaagctgtggttatgtgaatacatattatcgtttccattattcagatgagaaaattgaggctcagaaaagtaaagtgacttatcctatgcaactgaatgaataaacaatgtgtctggaacgagaattcactttctgtggttatagtttggtgctccatgaagtaaattgaagacatgtacccagaaagatttcagggaagtttgtcatcccaagataccatttgcctgtgattgtaattaaaattgggagcagatgaatcaagaagttagatgaggctgggagcgcggtggctcacacctataatcccagcattttgggaggccaaggcaggcggatcacttgagctgaggagttcaagaccagcctgggcaacatggtgaaactccatctctacaaaaattacaaaaattagacaggtgtggtggtgtgtgcctgtaatcccagatactcagga

SEQ ID NO: 339671 - DNA, 288 bp, Homo sapiens
ttgtatattggaacaagctttcatgtaaagactacatgggagataactttttgtagatcttctggtgatttccaaacagaaaagtatagatctgggtcctagtgtgaatctacacctttgtagaataagactacaaaagtgagagagatgacctgaatggcttccactccctccatctagctctagaattctagtattgtaagtacttgggaattaagttattttacaggttatctagcatatggttaaagcagcaagctttcagggatatcctttgtgagactttga

SEQ ID NO: 339672 - DNA, 149 bp, Homo sapiens
cagtaaagctcctctgaggaggcaacatttaaggtgaagcctgtaggttgagtaggatatatccatgggagaagggggcattgagtatttcagggagagagaacagggtgtgtgaaggcctttagacagaagggaacttgatggtcagg

SEQ ID NO: 339673 - DNA, 683 bp, Homo sapiens
actgggttcctctcggttgttggcagagttggggtaaaaagagaactaatgcacccattaaaaactctatcctgacccccaaaatggaactcatccattttattttttccaccaagctctagcacataccaacaattaaaaggtattacagtgtggggaaatctggggatgcccagctccacctacaaaagcaccctgtcatcagcccagagggccatgttagcatcctgggaggttctcctgggcagcagccagcatgttgcctggcaaaggctccacagagacgaaatggcttctcacaaaccctgcctctctatgatgacttccacctcctcacctgctgcacctgggtccccaccctaagaatcctagaagctgaggaggtcgttctccatccagcctccgggacactccgcaggcacatgacggtcagatttatgttttaaaaagtgtcccctggctgctgattgcattggaggtgagccagagtgactcgggagacttcacagaagaccagaagagagatgatggttggactagagtgacggggctatggcttggctgtgtctccactgaaatctcatctcaaattgtagcttccataattcccttgcattgtgggagggacacagtgggagacaattgaatcatggaggcagtttcccccatactgttctcctggt

SEQ ID NO: 339674 - DNA, 112 bp, Homo sapiens
aaaataaaacaagcagaaaagtacttccacttgctatcaaccaaatttacaacccacttcatctatgcccacatacttgccttcatttttgtaacaaaggatgagcatttct

SEQ ID NO: 339675 - DNA, 1325 bp, Homo sapiens
gatttcgctctgttgcccgggctggagtgcagtggctcaatcacagctcaatgcaacctcgacctcaagggctcaaggaattctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcccgctggatacgttaaccgaggcatggtagacctggccctcgattccaggaacctagggtggtctgaaaaattaatgactctggcatttgaaaattaaagtgagaccctgtcttaaacaaacaaacaaacaaaaaagcatgatcacttggagttaacagacttaggtgtgcattctccatgccagccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttctagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgcgggcagagtggggtgatggctgttttcctgttgtgca

SEQ ID NO: 339676 - DNA, 1234 bp, Homo sapiens
gatttcgctctgttgcccgggctggagtgcagtggctcaatcacagctcaatgcaacctcgacctcaagggctcaaggaattctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcccgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacgctggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcactttgttatcatcaggagtgtggtggcctcctggccagctggtctacgacagggccatgccgggtcaccagctgtgcctctgcaggggtctccagccttgg

SEQ ID NO: 339677 - DNA, 297 bp, Homo sapiens
atactctgctggtgcaaactgaaacagttagtcaaaggtttctcagatattcttgcaagtgggagcagttttctgtcaagtttttgctaaccacccactttggtgtgtcaggctaaaatattcagtgtctgatgctctgatggttggtcaaaactttcttgaccctaataccccaggtattccaatatccatgtcatcgactctgtgagggtccagatttttcaacagatttcaattacaaacccccacagaacataccagaaggtaagccgatgcctcccttcacacttttctatg

SEQ ID NO: 339678 - DNA, 762 bp, Homo sapiens
tggagatgcactgaccttccttgcaagagcctttccctgaagttgggctcctgagagaagttctgaacatggctatccctgccttttcatcttgtcagcagatttcttcagcagctgctctacaaatatgcaatggaccctttaagcatttctcctttacagtgagcacaatgctaagctttgtcagcagatgccactggagcagcattgcagaagaaagcgagtttctcttcctgattttggtgtgctacttttcttcttcttgctccagctgcattatccatcagtggtactatgtataagaccatcccgctgtgccctgccctaccacctgcccagaggcacatccctcactgactatttggcctgattctgagcctgtggccaccttctcacagccctgcaacacaggcactgtgtgctccaggcctcacgtccccagcagtggcctgactgtgcacttagccacagcctcagtttgcctgtgctccaagaaattgcatcctatttgcccagcagctatggaccagctcctggtcctggaaaacagcaggcttctctgacatctagtggactgcaaacacaccttctccaacaaggcctgaccccagccttaaggagagaaccgtctttccgagttgtctttccttgggtactctccctcaatcctcggatacccttgaaagttctctttacattgttatagttattcttctatcactgtcgaataattttttatattaaacttctcttgctttacat

SEQ ID NO: 339679 - DNA, 1370 bp, Homo sapiens
aagtatggtttacagataaaaatggtttatgggtaaaaatgaggaggaggcagaagacattgtaggtttgaagagagaagagataaaagtttttctaggagagtgggaaagggaattgatgagggaatcatagtatgatttcaggcagctgtgaccattaaggtttgtggtcaaacaatgtttttcagtggagatgctgtcagtgtttcaggcaggcatcttccttggcatttagcatccctggcccttggtagtacccctcaatcattgtgctgatcaaaatgttctctgccccacttccaaacactgcccagggaactgaacctttcctggttgaggaccacagagagaccaatcacaaagttgcatagttttcttcagtcacattcagatgttggcagggactatgcaaaatctgggtttatgagtgttagggttagacagaaaaggacagtgaaaatagacagagtcaaaggaattgaaagtgtatgtaatgcagtaattataacagattttatgaacaacaaaatacctctgctggcctgaggcaactcaggacaccacagtgggaagggaattcctggctaccattgatgaacatttggacatgtgtccaattttgggctattattaataaagcttatatgaatattttacacatatctttgggtcgacatatgcatttatttctgttagtaatatacacagagaaatagagttctcttgggacttgcttgatcaaagggaatacgtatctttagctttatttaaaattgctgtatatttccttaaaaattacacatacacatactatgacttagccattccatttctggtatttacccaagagaaaataaagtgtatgtctgcacacacaaagacttgcaaattaatattcatagcagctttatttgtaacagcaaagaaccagaaacaacccaaatgttcaccagcaggtaaatggataaacaaattgatgtgtagccatacgacagaataacattcaataaaaaacaaagcaaacaaaatgacttctgatacacacaacatgggtgaatctcaaaataattgttttgggtaaagaagctagacacaaagaatacatactatgtgatttcatgtatataaaattctagacaatacaagctaattcatagtgctagaaagcagatcagttgttggctgcgtgtagtgaggattgattagagagaaagggaagaattgcaaaaggcatgaggaaacttctgggaatgtggacatgttcattttttttggcatggtaatggattcatgggtatatacatatgttaaaataaaaatatcaaattgtacacattaagaatgtgcaattgggctgggcatggtggctc

SEQ ID NO: 339680 - DNA, 364 bp, Homo sapiens
catcttgccctgaaatctgtctccttcttcctgctctggaacctgctactccttcttcctgctctgaaactgctgaaactcgcctctgtattcctgttctagagccacctacttcttcccgagctggaacctgcctcttccttctggcactgggatctgactcctccttcctgctctgaaaactgcctcctccttcttcctgccctggaacctgcctcctccttcctgagctgggaactgccttcttcctcctgctctgaaactgccaaaatccaccttcacatttctgctctggaaccaactccctcttcttgctctggaacctgcctcctcttttctgctctggaacctgtcttctccttcc

SEQ ID NO: 339681 - DNA, 307 bp, Homo sapiens
tgatacagtccaagaaacactagggagcttggcaggatctggggagctagctgatcagacttttcactgtcccagcctgagtgtatttgtgctatgctttttccagttctactggctgatgcacaattcaggtcccctgttttcttattttttatttgttttgtttgacaggcacatttactctctggcagcacattcttctaaaggcctggtcataaccaattagggacttctcatccatattatgaattaacctgtattagtattttagcagagattatttaaatcatttgttaggtgaataggg

SEQ ID NO: 339682 - DNA, 332 bp, Homo sapiens
tgttagggcataatagagaggaagaaaataaaactacagcaaagatgtaaatgacaaatcaagtagggctttttcacatcactgagcagagaggtacatgccagcttacacagctccactaggtcttccgtatccttgtatacttccattctatggtgttccatgtgcaaaaactgtaccaacaaagtaaatacaaacaactctcttctttttcatagctaaagcaaaataacgatcttcttgaaatctgtactggtcaggaggcatgagtttggggattacctgtaccgtaattaggtaagatggcagtgaccatgccactgataacacct

SEQ ID NO: 339683 - DNA, 112 bp, Homo sapiens
tcaaaaacacactcctttctcatctctttgagtattttaagacaaggcaaaggtataaggtcctaatttgtttttatataacccatgccaaggccataggcccaggcctgat

SEQ ID NO: 339684 - DNA, 548 bp, Homo sapiens
ctctcctattggtgctccactcccgaaaacatgagtgaaaggtaaattcacgtgtggtctggtgcctggtgaaacctactaggaggtgggagtcaccatgcagtggctcctggtttccatcactgtacttgcaaaccctgaggccgtgtgccacacagttgaaaacgaacacaggctgggcttcaagacaactagttctgttactctctgcgtgatctcaggtaaagccctgaactgctccaggcctcagattctcacctgtgaaataactaaagtagactagatcatcgctagatcgttgctgatgtccttccagcttcttttttttttttttaattttttactttttgagatggagtttcgctcttgttgcccaggctggagtgcaatggcgtcgtctcagctcacggcaacctctgcctcacaggttcaagcgattctcctatctcagcctcctgaggagctgggattacaggcatgtgccaccatgcccagctaatttttgtatttttagtacagatgtggtttcaccatgttggtcaggctgg

SEQ ID NO: 339685 - DNA, 522 bp, Homo sapiens
ggcaccaggccctcatggatgggcaacagtctaatagagaggaggcagaaggtcactgtgggcaggcagtccagcagagcagcacgcagggtgcaccaaaaggagcctggaggcccagagcttctggagggtgagaggagaaggtgggtgcagagggcagagtggatcccataacgtccaaaattttttcaagacagaccaactctacatctactcctcttatccgctgagtacctccaaaactcactgaaaaactccatagatttagctgaagttcttagcacttctgcccattcttcaatagaccagaaagaagaaaggaagcagcaggaaatgggcggaagtgttaagttgcaaatcctggcagcatgcccagaatgggaccaactcagcagacaggaagcgaaggcaataaaagagcaatctacgctacaggcaggctggagcagaaactcgggaaaggagggaagacagattactggaacagccagtttgcagggccatgaaacccgaactcttttc

SEQ ID NO: 339686 - DNA, 240 bp, Homo sapiens
gagggatgagggcagtggctttggcatcctgcaggctgggttccaaatctccattctgcacccgtgtgaccttggacaagttacttaactcagcctccatgtctttacctgcaaaataggggtgacgctgcctactgcttggggtggtcgtaagagagtcagatgaggtctcctgtgtgaagcatcagcacagagcaggcactcattgacatcagctataccacaccacttcctctgctg

SEQ ID NO: 339687 - DNA, 200 bp, Homo sapiens
agatttatcagcacgtcctaggtcaagaaggacccttcaacagtgcagtgtcaaggtcctggaaccagatctcagttcaaatcctaactccaccctttgctggctataggactttcagcaacacatggctcaattctctctgaacctctgtttcctcagctgtaacatgggagtaacagcaacctggccaggtgcggtgg

SEQ ID NO: 339688 - DNA, 233 bp, Homo sapiens
caacagttgccttctgcaggggtggggacagggagggaggtagggccaaggcgaggagcattttacatcagtgacctaacctggggagctatcagggcctatcttcagctggccttaagaggaaaaccagatcgctgatgggagaatccacaggagggagaggggaaaagggaatgtggctggcaggaggcaatagccccttcctttctgggcacaggaaggcagtcagggca

SEQ ID NO: 339689 - DNA, 274 bp, Homo sapiens
aatcgcttgaacccaggaggtggaggttgcagtgagctgagatcgtgccattgcactctagcctgggcaacagggcgagactccgtctcaaaaaataaaaacaaaaaaaactctgccctgctcacccttcagttgtcaggccaggcaggggcatcgccagcctcgggggtctccagctggcaaagaggcaccgagaagtctttcatcacaatgaatcttctcatatgtctaatctgggggctgtttatatgtagagtaatattctttcttaagt

SEQ ID NO: 339690 - DNA, 255 bp, Homo sapiens
taaaagcataaatttaaaaacgcaagaaccccaacaaatcccaagcaggataaacggaaagaaaaccgtacctaatcatgtcacagttaaacatctgaaaaccaaagatgaataatcttaaaagcagcaagaagaaaatgacacattatacccagaggaacaataacataaatgaatgctgacttctcatcaaaaacaatggaagggctggctgggcaaggtggctcacgtctgtaatcccaggactttgggagg

SEQ ID NO: 339691 - DNA, 564 bp, Homo sapiens
tcttgagagagaaggagtcttcctctgttgcccaggctggagtgcagtggcgcaatctccactgcttctatttgctgtcacagggacttccatcccagcatagactttcattgatcagtttccacagttccccctgcagaagctccccgggccacctccagggggcgtcctggaccctcccctgactggctggagtccccccaggggtccagagacacccacgtcctcttagccaggagcgggtggcagcgccaagggaccctgatggggcctggctctggcccatgtcgtgctgcactacccgcccaccacacactccaggcagctgtcaaggacaaggggccctgggggagcgtggcggggatagcttcttgcagggcctctggtccccgtggtcctccaggcggcgcagacagctccatctgcatcccccattctgcccctgtcacagtgttttcctgacaggctgggggtggtcagcctctggtgcagcaaggataggtcctagccacagcgttcattgagtgcttactgggtaccaggcacggttcagctcccagaccc

SEQ ID NO: 339692 - DNA, 698 bp, Homo sapiens
tctatcctggaagctgaagaaaatggctgtgatacttgtgatatggaatggaactatcaggactgcttattatgcaaagtggggtgccaacatctaagttggccttcagcatacagagtctcttaattgtcacatttccctgttatggaacctgagttgaccttatttttccatgctaaggattgtttatccctcacttaagtcagatgaaagttgaagccacactatgcattgtgctgcctgtctatacccaaagcatacctccttgctaaaataattgattcagaaatttgcccgtaagagtcacaactttattttgtgcatgttagtatattaaccagagattccattcacagctggaaaattcagctgaagtgcctctagcttattgcatctgcctccacctggaaatgttgactagaagcagcctatatttttaacatacatctacctactttataatgctaagaaaaaagggcccaagaggaaggggcatggatgccactttgcatgctatggtttaactctaatcaatttgtttgccatccggtacagtagttacgatgcttggcaggctaaccttgtttatatatttggcctcggaacttatcaggataacatttcccactaggagctctattccctaacctctcagacaccaaagattgcagaggaattctttctttcaacaaacatct

SEQ ID NO: 339693 - DNA, 168 bp, Homo sapiens
ttgtgcagtacccaacctgctcaactgtccatggcaggctgcatacggagcagccactgtactaagtcctttacgtacatgaactcatggctgtggccctgtgaggacttgcacagatgagaaacccaattccccttttgctgacaggctaggaggtctcagctaagg

SEQ ID NO: 339694 - DNA, 426 bp, Homo sapiens
cagcctcccaagtagctgggattacaggcatgcaccaccacacctggctaatttttgtatttttagtagagacagggtttcaccatgttggccaggctggtcttgaactcctgacctcaggtgatcctcttgccttggcctcccaaagtgctgagattacaggcgtgagccatcgcgcctggccagtagtcagtatttttaaatgagcagctcatataaattgagcatttcatcttttctagaaaaaaaagatttgggaacgtttgctaacatcagttcctgtgtagccacaatggactgctaaagctaggcagcagctactcccttagacaaattccatattctccagttagccacattcctacctctccttactgtctctggcatacagctgcatcacacctttccactacgtgccgacctttg

SEQ ID NO: 339695 - DNA, 731 bp, Homo sapiens
  misc_feature (440)..(440): n is a, c, g, or t
ttacaaattcttcagtaattggtgttataagatattttagttcatttcagagcagctgatactgatgaagccagttctgtctgcccagtttagggactggaaaggaacatttttcagctgcgttgttttttgttgttgtttggattttttaagatggagtctcactctattgcccaagctggagtgcagtggtgtgatctcggctcactgcaacctccgcctcccgggttcaagcaattctcctgccccagcctcctaagtagctgggattacagctgcccaccaccatgcccagctaaattttgtatttttagtagagacggggtttcatcatgttggccagggtggtcttgaactcctgacctcaagtgatccgcctgcctcagcctcccagaagtgctgggattacaggcatgagccagtgtgccccgccatcaggntgcattgtgtcacatgtttatataaatgccatttcagaagacatattttaaaatcaacacttttcactactattatatctttacaaagaggtgaaaattgtcaccttcttaggtggcttattcccagaggcctactagtcttacctcacgtctgggggcaagacaagaatggccaggtagcagcagggccagaatgtcatcttgttaggcatatggagatcagaatttcacaccacatccctgagcgtgctgtttgaaccaaagttttgtgtggcacacggtgtagttgtg

SEQ ID NO: 339696 - DNA, 919 bp, Homo sapiens
ccccaaactatgtcataaacaatcactctcccggaatcctatactccccccaaccctcctccattatctcccaattccactagaagcctccaacagcagacgaactctttgaaaacacaaaagctccctaacactttaagatgaatcttaaaccataaaaatgtttcacaaagccaaaaaaaaaaaacaaagaaacctcacaaatgttacaatagcagacatgtgcttactgcacgctcgctgcgagcttactaggtaggtactgcgctaacaattcctaatcctcctcggtccctaggaagcaggtagtgttattaatgcctagttcccgatgagacacaggtgaaatctcctgtccgggttaagacaggtaggaagtcaagacgcgagcccagacattccacctccaggactggtactctcgggctctttgcttctgtctctccgggagctccccaaattctatgcccaacaaacactccaaaacacaaagggaacccgatcccgaaaacacaaccgaaccttccgcattacaaacgaacccaaactccaaggtgccccttaagcgcgagagaaccccaaaagtatcccctaaacccacgttaaaacttccccaagccccagaacattttgcaaatggaaaaggaacccccaaatcttgtaaccgcccccccaaagaaatcttccaaacccctcaggtgaccctcgaaacctacacacgcccccaaagagccctcacccgcagcccccccaggcggcgggagaaggctgcagcccacacgcatgcgcgcgaaaggtaaaagggcccgccccctcgctccttccctccggccaccgcgcgggcagactagcaactagcttccctccgcccttttgttgacagacgcgcgcgtgacgctctcagccaatgagcggccgc

SEQ ID NO: 339697 - DNA, 618 bp, Homo sapiens
ctttatctccactccataatccccaatcccacctacccctcaaatacttacagtccctgctgtaatctcagctcagtgttaaaaatatcactccacagcctccaaaacctatagatggctgtttaccaaccaccaattcacatacatgttgagtatctcaaatctgaaaatccaaaatgctcccaaattcagaactttttgagtgccaagatgacactgataggatatgctcattagagcatttcagatttttcagacttggcatactcaactgataagtataatgcaaatactcaaaatccgaagaaatccaaaatccgaaacactttttagtcccaagattttcgggtaagggatacttgacctgtataaccaactgcccagggaggcaggctaacacagcaaaagccagtctctacagatgccatcctgctacaacctggccaccccctcaagtcccctaatcagttccaaccttacccccagcatctcaatgtcctcccccaaatatcgaaaagctttcaaatactactttaaaccaccgaacctaaaaatatcctctccagcactgaagggccgaatctcagtcaatctctcacagatcccaacacagcaatt

SEQ ID NO: 339698 - DNA, 352 bp, Homo sapiens
ctgtacaaccccttactgatatgaccccatttgttgagctgttgtggatgaaaagaacttaattgggttagtaaactggagaactgttttgttttggtgttgcaaacccatttgggtagaattagaagtgaaccctgaagatgtgactgaattgctgcaatctcatgatcaaacttcaacagatgaggagctgcttcttacgggatatgaaaagaaagtgttttcttgagatggaatctacagctggtgaacatgctgtttatttttgaaatcacaataaaggatttaaaatattacataaacttagttgataaatcagtgtcagggtttgagaggtaggaaggttgtaggg

SEQ ID NO: 339699 - DNA, 356 bp, Homo sapiens
ctgtacaaccccttactgatatgaccccatttgttgagctgttgtggatgaaaagaacttaattgggttagtaaactggagaactgttttgttttggtgttgcaaacccatttgggtagaatttgttccatgggtcaacaactctgtatcccctggccatgtataagaacatcacaattatgtattaccagccatatatccgaatactatatgctacttctcctgaagtcggcagcagattgtatatcctaataaacacatctgtgggaagctatcttaggacaacaagatcttcattataccccaagaagatctccagacctagggtgattaaaacattaactgcagacattaaa

SEQ ID NO: 339700 - DNA, 408 bp, Homo sapiens
ccttgtgcaggcagccagagtcctgggctactcctgacttgctgggtaatcccaaggagggcctttttcctctcttagtttcatcgtttgtctaatagcaaagagcgggaaggctggggtgggtgtgctgacttgagaatccactgtagatgagagtttccctcacctgcccctccttaactacattggaggtgtgtcattcgctgccattgaaatggtttgggtggactagctggccttgatgatagggtgcggtggaggggacatgcaggggttgaaagcagacacctgagatggaagcttgtggtaccttatgtgatttgaggcagggccagctagccgtccaccaggatgggtgcatctggtgccacagggtgagtcatcactgcacaacaattgctcagccag

SEQ ID NO: 339701 - DNA, 306 bp, Homo sapiens
ctgggattacaggcgcctaccaccacgtctggctaatttttgtatttttagtagagacagggtttcaccatgttggccaggctggtctcaaactgctgacctcaaatgaactgtctgcctcagcctcacaaagtactgggattacaggcatgagccacctcacctggtggtgaagactctaaaggctcttctcagatcagcctttgtcctgaatttcacatgcccgtgtccagttccctccccagcatcttttcaggagttccatggactcacctcttcattatccagggttaagctgcagatatt

SEQ ID NO: 339702 - DNA, 4487 bp, Homo sapiens
gagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtgactcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgacgtaagacccagattgctatttttattgttatttttcaacagtgaatctaaagtttatggttccagggactttttatttgacccaacaacacagtatcccaggatatggaggcaaggggaacaagagcatgagtgtttttccaagaaactggtgagttaagtaagattagagtgagtgtgctctgttgctgtgatgctgtcagccacagcttcctgccgtagagaatgatagagcagctgctcacacaggaggccggatatctgataagcagctttatgaggttttacagagtatgctgctacctctctccttgaagggagcatggcagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgtaaaacatccttttttccagcctctgggaatcagcccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctgggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcc

SEQ ID NO: 339703 - DNA, 434 bp, Homo sapiens
gtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactg

SEQ ID NO: 339704 - DNA, 276 bp, Homo sapiens
ctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggc

SEQ ID NO: 339705 - DNA, 6393 bp, Homo sapiens
cgcggccgctatatataatgcagcatcacaccatgtagggcatttactcttattttatacattcagatatgtttgaaacattcttaaggctacaaaacagaacatagaaaaataaacaggaatatattcaacacttacaaaaagtgatatgataaagaatataaagtactagtttccttttaacacttcaaaagatatgtatatatacttttttttacaagtaacatcacaaatgctcacatcttcacatgctcttaaagtattatttgtactcagtgtaaggctattatcgtttttcatacataaaattttctagctctgtaacacaatgcaatttttaatccattcagtaagttcaaccccaaagttgccgcttcccagcattaagacatgcacccacccctcttctaagattttctaaacttgtatttcggggagaaagacctcttttaaaaaataatccaattagtgggagagtaaatggctgacattagtagcaaaaccttagttatctgaaaataacatattggaaatgagacattattaggattttaaacaaacaatagcatttagacataaagtaggaagcaaaatacagtaaacagaaatagtgtagccaaatatcattctcttcagctaccttaagtaaaagacaaaacatttacctcatctaaaaatgaaggtaaaacgaaagaggcaaaaataaatattgctagtttctaggatggctgaatgttttctaaaccagaaatggttagaaaggaactttattgcaccaagtcaatcataagcaagtttgcagttcacaggcattttaattcaaccttgagtcacaaaggagaacaacacgctgcgagaatacagtctacagtctgcattaaataagaatatatcagcattgtggtctgggaaaacctatgcttgccaggacaaggcagggtgctgagcttaggtcatgccatgaaaatgaatttgtgggttatcagtaaacagtatgaggactacacagatgccagcatcctgctgccaaggagacatggggcaagagttgaagatttgagaggaaatgaagagacatacacaacaccaaaggaaaagggggctggaatcaagttcagccaaagcacctaacacaaaaaacaggtgagctttggtcagtctgttcttcaaaatatgtatgatcatatggtaatgaagtttcataatttccaactcaaaaatacaaatgatcctcagttctatacttttgcctctattctcttataaagaaatatgtcaacataacagtatgacataacagttaaaataaggacaaaagcttgcttatcttagtttgacctcagcataaggcaaaatcccctggagaatacatttaaaaacaaacttaaaaggaaaaaaagcgaaaccaacttcatgcaaagattccttttaaaactatcaaaagtcagttcttttattccagaggtcactgagaaaagtaccatctgctaaaattctctttcaagcacttcttccatcatatcctagaggtgagatatgggaaacagaaagcaaatcagtgttcctcaggagctatatctgttactcaattgagggtaagacaaagtgacaatgaagatatgagtagtatttccttccaatttttaaagattttcagaagctgagatcaaaccccactcaataaaatgcaggagactagaagcaacaacttattttggactcctgagatcaaacacattgaactttcaaatctgggtgtttctatcaaaatgtgattttcataaaatcagtaagctagtcctacataaaaaagcatgagctgaaagtggaggaccctctatcttctcattccttaactgagccaccgatgttaagaaaaaaatggcttaagcggtaccttcaacaactattctagttaagaaggtgacaacaaattgaggccgcgaattcggcgaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtgactcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgacgtaagacccagattgctatttttattgttatttttcaacagtgaatctaaagtttatggttccagggactttttatttgacccaacaacacagtatcccaggatatggaggcaaggggaacaagagcatgagtgtttttccaagaaactggtgagttaagtaagattagagtgagtgtgctctgttgctgtgatgctgtcagccacagcttcctgccgtagagaatgatagagcagctgctcacacaggaggccggatatctgataagcagctttatgaggttttacagagtatgctgctacctctctccttgaagggagcatggcagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgtaaaacatccttttttccagcctctgggaatcagcccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctgggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcc

SEQ ID NO: 339706 - DNA, 338 bp, Homo sapiens
caacacagaagaggaatgtgaatgaatggtcagcaatcatataaggagatgtttaagacaggtacagtggctcatgcctgtagtcccagcactttgggaagccaaggtgggtggatcgcttgaggtcaggagtttgaggccagcctgggcagcatggcaaatccccatcttcaataaaaatactaaagtagccaggcatggtggcatgtgcctgtaatcccagctacttgggaggacggaggtgggaggatcacttgagcccaggaggtcaaggctgcagtgagctgagatcacgccattatactccagcctgggcaacaagagtgaaactctgtctc

SEQ ID NO: 339707 - DNA, 328 bp, Homo sapiens
attctaagaaacaatgttaaaagggaggatgatgaaattgactttcagtcctttaaataaatgattattgaaatagtttactcctgggctaaagataaaagttttgagcttcgattctcctatgtcatgctgcaggactagcgacagttttctgagtttattaaacaagtacttttaaaagtataaatagaatgtgtgtgagctgtattaggaaaaaggaaacgtaaagaaggattgtgttttcaattaactccactcatggaaaaaaaccttccatcttaacctttctcacctaaggggcaggatgttcagttatttcatatttttg

SEQ ID NO: 339708 - DNA, 656 bp, Homo sapiens
tgaaaagggttctgcttattggaaaaagaaatgtttgaaaatgactggtatccaatatctttgtttcatagatgagaaaactcaagtccttggtcctcagtcatgtagccaattcatgacagagcaggactgaacctcagcctcctgacaccaggctagtggacttttcccaatgccttcctgccttgtggggtagaaagacaacagaggttctcactgctgtgttgcccaagagtcttacaatgagtagcctgcatatgaagatggtacttgtgacggaccacattgcaccagagcacataactggagggacaggagatggtggatttgggctcatttttcatccagcatattctcagcctccctcttcaataagcctgtaaagacctagtaatcctctatggcctgaactgttcctgggttctccaatgctctccccaccctctcaccccaccattccattagctgttcaatggctgacctttgctggggggccaattctatcaagggttattctgagacaatgaaatccctgccactagccctccaaaactagtattagccatccctaccccatatgtgtgcacccaaagcacccagtgcacctggagcacctcatacttccttgcacctactgctgtcaaataagagtctgt

SEQ ID NO: 339709 - DNA, 696 bp, Homo sapiens
gctgccactctaagcaaacagatcccgagccctggactctgaagcttgggcccagttctccttttctccgggtttcagatcccactgtgaagtgagggggcccttctgattcaggacccggggaagccaggggcatgagcatcggtgcctcttctctatttcaaggacccttctgggtgtaaagttctctgagatgccttacatggattcccaccactgcaagataaccatcgtatgtaaagtgttatgaccagcagagcgtaattgaagtgcattccagagggaaagacagcggctcagagttatgagaccctaagcagtcatggcccagttcagccactcccggactcctgacccagggaacctgtcagatggtcctttggaagatgaggatgaagctcttgtgaatggaattcgtgaccttatagaagaagcccaagagagctgccttgtcctttttaccacgtgaggacacagcaagaaggtgctgtctgtgaaccaggaagcaagctctcactagatttggaatctgccgatgcctccgtcttggacttcccagcctctgggacagggaaggagtgacagcttccaaactgttgatctgtcagtgctgaaaccagcaggtcccttcagcgagggccaaatgagcggaactctccaggatacgtctgatttatatgatgccctctctgggtc

SEQ ID NO: 339710 - DNA, 720 bp, Homo sapiens
ttgaggaggcatgttcaagatttgtcaaattacaagaatttgttacttgaatcacatgacatcactcagatgacgccactcagactgataatacagctcagccagttctgcgatcccacccaggaatgaatctgactctgcttgaattactctctctccattgcaattcccctgtctggataagctggccctgtctaggcagcaggcaaggtgaacacttgattacaaaaggatgaagaaactgaagaatcaacaactcttagatcgatcagagaagcgagggcacagggcaaaccactgcctccaaaactggaaagcctgtgtggatgaatattgcttccaggagtcacataattacatctaaaatcatagaatgttagagctggaggaatctttagagtttgcccaaggtccttcaccagcattttacagaagattcttcgatttaactgctcttaattacatcccgttgcactggccccatcaagttgctttaaacagcccttctagtcaacagagctgcagagaaaaaccttggttggttcaggtcactaggatgcaggaccatgggcagccagctagcagcagtgtgatctgacagcccctttcttcagctgaaacaattctccactcctcatatctgaagttgcttccaaaaatgagctgcccacacacagcccttgccccaggctttgctctctgagaaacttaggctgagaa

SEQ ID NO: 339711 - DNA, 599 bp, Homo sapiens
ctcagcccgtctgtacccaggcgctcattagaacagcgtgttgctccacaccgccttgtggtgtttgttaccgcgctcttggggttcgaaccgatacagcaggcttgcagctatttcattggtttaaacttttatttttttattgcaaatgaaaattactatcaactatcattacaaagctgtagaatatgaagttcgaaggaaaacgctgaatcagtatacaaaagcgtctcaatcagactcatccattttgaagcaattcctctgccattttgccacctcctctcaaattcagcgacttaccagaaagcctgtgtggatgaatattgcttccaggagtcacataattacatctaaaatcatagaatgttagagctggaggaatctttagagtttgcccaaggtccttcaccagcattttacagaagattcttcgatttaactgctcttaattacatcccgttgcactggccccatcaagttgctttaaacagcccttctagtcaacagagctgcagagaaaaaccttgagctgtcacacttcatttgtgagaacactccagagcttcctccagctgctgattccaaaccagcttcac

SEQ ID NO: 339712 - DNA, 398 bp, Homo sapiens
aaaaaaaacaaacagaagtttattaacatgtatttcatatacacatgggagatacccagggactgagtaattcttcaacaggtggcttagaactccaggctcactatagcatctttaacaaagaagaatacattttagagaaggataatacattttagacgagacaaaggaagaggaccttgagtgtctagggacagcaaattgtgggaaggcaaatctatgggaaactaattgtgataaaggctagttagcaaagtttgttatgtagagtcctctggtatcttctccaggctgataaagatctaaagtcatttccagtgattagcttttgttctttctattagagagggaaggagagacacctttgtaaatttatgtcttctttttaggcaaatagc

SEQ ID NO: 339713 - DNA, 1113 bp, Homo sapiens
gctcagcgggactttgcctgggaggacacgtacatcagctaaagtgtgccccctccccatgtccctagtgggtgacccttgccccttgctcttctgctcacctcccaagttaattaccctagtgagcacactcccttattaaaacatcagggcagctgggggaggatcctaactcacgggaggctgtgggggaacagcctcgttgacccgtgtgtgacacagcggctgtcgtggaaggcaaactcggtgtggtctgtggggctcccatggtggggtgaggcgtggagtcccggcctagctgccccacctgagaggagggtgcccgggcagcctctgagacttgggctgggacccttggtctggaatctgcacgctacagccagaatctgataggatcccatgttactcggggtgggctgtttttgaagcagcatccacctttcctccagccccaggctgcggctgctgccactggaatatttggggtcttcctacgcacgctgctgtgctcccttgcgttctcctgggtgccgaggtcctggcacgtcgtagtttagagaggccccatcttcagactgcagcacagtgacccacactgagggagtttatgtccacagagacctctttgttggggacaggacctttctgagaattctctggggcgaccacaggcaattctaggccagcgggtgggttgtggaacctgactgggctgacacctgggctccacaacccactgttagggcaggaggatcccacctgtaccttcttggatcccaggccactcgaatggagtctggcgtccttcctcctcatgcaggtgaccaaaccctcaaagtcactccagtgtgcaaaggcctttggccaccacagctgttcaaaatctgctgtaactaacaggctctggtcttcaccctgatgtatttattccacccacggtggcccatctcatgtggattcccagtaggccagcccgttttcaacaagaacagtcttctatcttcacattagaaacccattagatttttggacttcacaactaaattgtgggacagttttccaggctaacattttgtatggtttctggcatgttttcccagtgtgaatggggcc

SEQ ID NO: 339714 - DNA, 1143 bp, Homo sapiens
cctttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaatacgact

SEQ ID NO: 339715 - DNA, 343 bp, Homo sapiens
ggctcacacctgtaatttcagcacttttggaggccgaggcgggcggatcaagaggtcaggagatcgagaccatcctggctaacacggtgaaaccctgtctctattaaaaatacagaaaattagcctggtgtggtggcatgctcccagctactctggaggctgaggcaggagaatcgcttgaacccgggaggcagaggttgcagtgagccgagattgcgccactgcacactccagcctgggcaacagagtgagactctgcctcaaaaaaaatcaagcctaggtcccaggtggggtttgaaggccatggcgtggtctcctgtagggaagagcaggttgtagagtg

SEQ ID NO: 339716 - DNA, 502 bp, Homo sapiens
gcatctttttttcatagataatggctactgaagtcatattatgaaatattactaacaagtaaaataacttggtgtaagatacctattcagtgttctctatatcccattcaacagaagagatgtcctttgctggttttgggtatccaagacctcacatctgggataacttggggtaggtctttgtagaagtggcctccaatgaattatgcatctctgtagccacacccttgggtagttcctccccgctgaccctggactgggtcatgtgacttgctttaggcaaaaggatcttaacaaataggatgcaggcagaggcttgacaggtttggtgaggtagggcgcatcctctctaatttctggaaacctttgagcctccatctgaataacctcagcccagcctccgtggaggatgagaaaacactaagagagctccagcatcccagccgaggacccaggcatggaagcaaggccacctggaaccatctagcctcagtcaagccag

SEQ ID NO: 339717 - DNA, 372 bp, Homo sapiens
acacagcacctaggatctatgaacaacttaagattccacaaaaatgtctgagattccagaagttattggctctaaaaatatgaaaagtaaaacctcaaaaccgaaatcaataaatttttaattaaatgcttaccaaatgcaaaatttttcagttagccaatggcaactcttctgagtttaacctgaaggcaaaaattttttcctgctactttgcagactgttataaaatgatatacaaagtatacataatacagtaggtacatcttaatatgttttaaataacatgtggtctggtgcttccagcttagggaaatcttaaaaatgccttgggtatggatattcggggaagggtataaaataccagaaaaatca

SEQ ID NO: 339718 - DNA, 453 bp, Homo sapiens
cctgaatcgtaagcatctaattaaatacaaataggttacttatatttatgtaagagctcttcagcttgtctatgaggcaaaatgccaacaagtgaagaagtacaggatggctctccagtatcaaatgaaacgatgtggagtgtgtgagagggcatgatttgaccttgacataagggtgataatgattctcagaagaactggaagttaggacactccagtaactcccctgagattcaacagtctaatttgtattagtaggaatagggctatatacatctctaacattttgtccagcttaaaatgctacctagcattattacattatctcataagccagtataaagcagctctagtataccatgaattcagtttcccttcaagttaaaaagcacatttctcgtgatctgtgacgtacgtttttctggttttttttttttagtccaagctaagcat

SEQ ID NO: 339719 - DNA, 383 bp, Homo sapiens
cccaggagacacaagccatgttctgctccagttggttcacgtagggtaaactgatgcctgtgacttctgcccaacacagtggcttgggaaggaaacacagggggtatccccaaaaccctctaaacaaatgctgaataacagtccagaaatgggttagttttggccaggcatgatggctcatgcttataatcccagcattttgggaagccgaggcaggcaaatcacgtaaggtcagttcaagaccatcctggccaacatggtgaaaccccgtctctactaaaattataaaaattagctgagtgtggtggtaggcgcccgtaatctcagctacttgggaggctgaggcaggagaatcacttgaactggggaggaagaggttgcag

SEQ ID NO: 339720 - DNA, 384 bp, Homo sapiens
tactttcaacaagacctatgtagacatggaactaatgaataaaaagaagtggtctggaatgatagaattttacagctaaaaaggacctgtaaaatcatgtacatcattctgcatgattcacggactaggagtccctggtcaaaaacttcaaaaactaagtgatgggtcccaagttactcagtggcagaaacttgattcagtaacatgtcagcttgtgggcttgaaaagtcttaagtgtctctacttcttctatccttgtgctttcccgggactttacacaatcccacctcccactggacaattgtcaaatcccagagagtatgggaagtctgttcatctctgatcaccataaatacgtatgcacatacacacactgcaatcggg

SEQ ID NO: 339721 - DNA, 222 bp, Homo sapiens
gcttgagccaccgtgcccagcctattcttaactttcaattgcagaaggctctctactcacaaggtccagcaattacatctgagtgctcattaataaaaatgatttcttgctatgtcacaatgaaagcactgtgaaattaatagccaagttttaagacatgaaatttctttttttttgagacagggtctcactctgtcccccaagctggagtacagtggcgca

SEQ ID NO: 339722 - DNA, 188 bp, Homo sapiens
ccaccccaatcacacgtgctttcatgccatcttctcatttgatgctcacaacaaaccaaggtgtcaggacaggatgtcatgcctgtccctaacctcagagaagtagccagcccagcactgcacagctcgttaccagcagagcctggatcccagccatctgcccatcgtgctcagtctagtcaccctag

SEQ ID NO: 339723 - DNA, 392 bp, Homo sapiens
gctaggtcagatttggggcccgggcagtccaggagaagtgcatttatgtcagcttggggaggtcgcaaatccgtgctgtgtccaagcccaccaggaatggattcaggtgtttataggtgtggggattcaccaggttaaacccaggcccgtgtgagcaccactggccctagaattagcctcacctggcgccggcctttttgtgatggctcctgattaaatacccactaattctggatctgctggtgaccacagagttcacctgatgggtcccctacaggcagcattcaatccaggaagtgccagcatcacatggtgacttctggtagctgtaacatttagtgactgtctccatgtcatgcacaggggtgacatcgagaccctcttatgcctgg

SEQ ID NO: 339724 - DNA, 184 bp, Homo sapiens
gaggtcccataggttctcccttgagaacccatcccaatcggccactgttcaccaccctgtccttgcccacccagccagtgctgtagccccgccatggtctcctggcagctgccttcacctgcctaaggtctatcttccgcttggggccacagggacccatgaaatcattccatcagtccacact

SEQ ID NO: 339725 - DNA, 153 bp, Homo sapiens
ctcttcacatcttactgtccacctcaatccggatactcctcaggtacctgaaattcaacatggcttcatctgagctaaccactttccttccccagttcttactttctcctttattgcctgaatgacatcatcattttctaagtcactcaagtt

SEQ ID NO: 339726 - DNA, 172 bp, Homo sapiens
ctataataggatagtgattcatattaggagttctaagacatctttttaaatagattgatttttaaaggtggaaataaaggttcagggtctgacaatacaacagatatcagagattttgttggagttttcaccatgcactgataagtctaggtcttggtgttaggagcattgg

SEQ ID NO: 339727 - DNA, 277 bp, Homo sapiens
ctgtgcccattatgcatcaggccctgctggggttgtacccacagaagacacaaaagtcagctgctatatgtctgcaagtagctaacatgttacccttcaaagaggaggcagtacactgagcatgcaaaaaaaacaaaacaaaactatttcagggagtgggctgggcacggtggctcacgcctgtaattccaacactttgggagaccacagagggtagatcacctgaggccaggagttcaagatcagcctagccaacatgatcaaacactgtctctac

SEQ ID NO: 339728 - DNA, 170 bp, Homo sapiens
attctagtttatacgtgactgtaggataaaggagaaacagccttgaataatttctacaaatgatcctcaacttgcatttaacagctgtttctaacctactctcatgcaaacttgagaggctcactaagagagaaatggtcatattccattcccctctcatctcttttttt

SEQ ID NO: 339729 - DNA, 326 bp, Homo sapiens
caaaagaaataacagattttatctgacttattatacatctgtggcttgatttttgcatgtacttagtggttgctttaagcctatagtataaaatgcagatttctaaaaatcatcaattcacttatataagaaagatttactgcagatgcatggtatgccagacatttttctggttgtaggaaatacgagtcagttaagtccctcgaggagaaaaacaataagcaagaatgtaagaaaaatgagtgagatattttcagataattacaagttaaaggaaattacacaaggtcatatgagagagggtgatggttgttggggattgcgga

SEQ ID NO: 339730 - DNA, 734 bp, Homo sapiens
tctcactgtcactcaggctgaaatgcagtggcatgattatagctccttattacctcaaactccttggctcaagtgatgcttctacctcagcctcccaagtagctgtgacttagcgggctactggggaggctgaggtgagaggatcattcttctaagaatgcaccaccaccatgcctggcaaatctttttctttaatttttttaagagatgggggatcttgctatgtttcccaaactggtcttcaactgttggcctctattgattctcctgcctcagcctctcaagtagctgggattacagacacaagccattctgctccctattttaagatttctctgtggtattccttattgttttctgtctgctatctttagaaaagataaggtcttccataccttttttttaaggaacaaaaggtatttttaaatgctacactgactgataggaaaatatgcagatccaatctttttaattctcttgaatctaaaagtaccgggttaccatatggaaacaataccaagccatccttaaaaaagagtttaaattctaaattgtaagagcagttataacaactttcagtactttcttcaataactatattttgattagcatttctgtgacattagtaactctgataaaatgatttcatgaaacaggaggaaacgaccaactcaatagctagaaaagaaacatttcaactagattaaaacaaagttaaaacttgtactgagacc

SEQ ID NO: 339731 - DNA, 330 bp, Homo sapiens
ctggcaacctttgcttctatgagttagattattttagatagcttatataagttgagtcatgatatttatccttgtgtgacccacttatttcacttagtataatgctctcaaagttcatcatgtcacatattgcaagatttccttttttaaagttggataatatttcattgtatactacatatatataccacaattttaaaaaagtatttgttcatccattgatggacattagattaatttcacatcttggcaatgctagtatcccttcaatatcattatttcttttttctttttttttttttttttttggagatgggagttttgctcttt

SEQ ID NO: 339732 - DNA, 3217 bp, Homo sapiens
gggagaccgtccaaggagggcttcagcggcagaggggagaccgtccaaggagggcttcagcggcagaggggagaccatccaagggagtgagtggggactaaaattcagcctgaagttctggcctacgtctgtgtcaaaggtgccccctttcaaaggtctcagcatcctcacgctacctcctgccgccacttccacctgggccccccgcagccgcagcagctcgctcccgacttcccgctggcccaccccgtgcagtcgcagccaggcctcagcgcccacatggccccggcccaccagcacagcggcgccctgcaccagtcgctgaccccgctgcccaccctgcagttccaggacgtcacaggtccctccttcctacctcaggccctgcaccagcaatacctcctgcagcagcagctcctggaagcccagcaccgcaggctggtctcgcaccccaggcggagtcaggagcgtgtatctgtccacccccaccgcctccatcccagcttcgacttcggccaactgcagacacctcagcccaggtatttggctgagggcactgactgggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacc

SEQ ID NO: 339733 - DNA, 171 bp, Homo sapiens
accgtggagagagagggagacgagagggagagggagagggagagctgtttcacagtttttgatgattgtgaataacgctgcctatgtgtgcaggtgcttttttttgtttgtttgttttgaggtggtgtctcgctctgtcgcccaggctggagtgcagtggcgcgatcttgg

SEQ ID NO: 339734 - DNA, 366 bp, Homo sapiens
gatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattgggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctctt

SEQ ID NO: 339735 - DNA, 347 bp, Homo sapiens
attgttcttaatacacatttttatgtttggtggcctcattcctattttaggagatgcagaaatcaaagcctcaaagaatcaaaaatgatagaagagcttttcagaggaataacactccattgttgagactcagaacttaagtacaaactgaagcaaacccaaaacaaattgctctgtttagcccagtgccaatctgagaagcgctctttttattcaagatgagatgtgctgtgacgtcaaccaaggaaacagaaacatcaaaagtggacagtattcaaatgatttctgtgggaagatgcagagcaggatccaaaacactgatctatatatttctgcatatgtttgct

SEQ ID NO: 339736 - DNA, 304 bp, Homo sapiens
acaaatctgtaaagaattccaagacctcttgagccaagatagatcaccactgggatcctccagacccactccaattctagaccttgacatccagagacatttaacacatttcagtttgatcactcatggctttgggactccggcaatatgtgcagctctaagcactttccaaacagttctcagtgaaatgctgaactacttggaaaaacacactactcacaagaacggcggagcggcggattctggccaaggacatgccaactcggagaaagctcccctgcggaaaacttcagaggctgccgtg

SEQ ID NO: 339737 - DNA, 1174 bp, Homo sapiens
tgagcctggctcagcatggtttttaaaataacaacaaaagtgtaaaactgtgctcgcatttcgagggccaaagagctacagctatctatgcccccaaggggcacagaagcttttttaaaaattgaggtaaaatctataacgcatggagtgcatgggctttaagtatatgaggttttggtaaatgtgcaaatccatgtgaccaccaccccagtgaagacacatttctatcacgccaaaaagtccccttccaattcttaacaatcattccctccaccccaccctggcaaccaatgttttgattttgacaagagagattagttttgcttattcttgaattttgtgtaaagggaacataaagtatgttttcttttgtgtctggcttcttgggctcaacatattttcttaaagattaagccacgttattgtgtgcgagtagatcattctgtttttattgctcagaagtagtctgaattgtatgaatatgccatagtctgtttagccattctcctcttgatgtgcatttgggctgcttccagtttggggctgtcatgaataaagctgtagttaacatgcatacatatgtcttttcatggacatgtgtttctgtttctcctggggatgccatcggaatggaactgctgggtcacagatagatgcttgtttaacatcgtaaggccatatggttttccggtgttgtaccatcttacgcccatcagcaatgtatgtgaattccagttgctccacatactccccagcatttcatccattctagtggctgggaacataaccctatgtatgcttgctttcctacctgtttcactctgcactttcctgatgggacgaagatggccagtcttcgtcccatcaggaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagctttggtttgggtcatctttatttagttggcatgaagttgaaaattaaggcatttttaaaaattttacttcatgcccatttttgtggctgggctgatgggagcaagatgg

SEQ ID NO: 339738 - DNA, 87 bp, Homo sapiens
agcaggagcaagagagagtgagaggggagatgcttcacacttttaaagaccagatcttgagagaactcagtaccatgagaacaacac

SEQ ID NO: 339739 - DNA, 338 bp, Homo sapiens
ctaactaaaactattccatcagtgaatgtaatttttcaaaaaaacatttaaggacaaaaaaattctcctataacttcccattacctagagattcaaggcaacttccctttgttggctttgaaatcaaacagacctgttttcacatcctggcttcctcacttcatgtccgtgtgatcttgggcaaaattacttaagctctctaagacttaatttccacataaggttgtttgagaattaaatgtaatatatataatatatttaaaacatatatcctatcagcacaatcgacagtagctgatgatgatgaattatggatgtgaattatgatccgcagggca

SEQ ID NO: 339740 - DNA, 217 bp, Homo sapiens
ttatttatttaaggttttgtgttttaacttctttgagctttagttacccttattaattgattaaaagtgggattgagttagtatatagtcttacaggtctaaaaattttcattcctttttgttgtatttttggtgagtttttttcaagatgagaaactctttatcaggaaacatttgtttaaagccagttacatgattatatatattttcttagcct

SEQ ID NO: 339741 - DNA, 546 bp, Homo sapiens
gcataaagctattgctttttgtctatcttataactgctgttcacttagccttattatatctaagtatttttagtttaattctcttgaattttctcagcagacaatcatatcacaggtagagatttatatcatccaggtagtggttaagagtaaaagctctgggttcaggtaaacctagattcaaatactgtgtgaccctgagtgagcatgttacctcagtttctttatccataaatttgcaattattagagggcctatctcacagggttgttgtaaacatcacattattcattaagaacggtgcatgaggccgggcgcagtggctcatgcctgtaatcctagcatcttgggaggccgatgcgggtggatcacttgaggtctggagttcgagaccagcctggtcaacatggcaaaacctcatctctactaaaaatacaaaaattagctgagtgtggtggctcgcacctgtattcccagctacttggggggctgaggcaggtggatcgcttgagcacaggaggcagaggctgcagtgagccaagattg

SEQ ID NO: 339742 - DNA, 300 bp, Homo sapiens
aagaatggggaccagggctgcgagaaagcaggacagtggctttccttcagcccttggtgctccagggacaaatcccactgagcacgtccctcaggaaaccatgcagggtcagaaccagcccccggcttcccctctgactgggctttcccgacccaggctctcaagccacagcctgtcagcatcacaggaaccagggcctggtctaggaccggctgttcaaaggccctgggtcacccctcaccagagagaccccagcacagcccaaaagagagaagcgatgcccctttccgggaagcccgg

SEQ ID NO: 339743 - DNA, 396 bp, Homo sapiens
gtagctgtatcacaaagagtttgaaataataacaaatgctctcatgatactatcgagtgaaaaaaggaaggaagctataacttacatatacagtatagccttgagaaagttaaaaaaaagcataggaaaaaagatgaaggaattacatacaactcttaaccaataatagtgatttatggattgtggtaagaatagacttttactctcttccaaattttgtacttgactaattttctatgataagcatatagcagcacacaacaatgaaggggaaaacggtgaaaaaattttagtagggcacatatttatttctggttatcacatccactgcatgcatgcattcattcattcattttcttgagacagagtctttctctgttgctcgggttggaatgc

SEQ ID NO: 339744 - DNA, 669 bp, Homo sapiens
ttcaagaccagcacgggcaacatagcaagaccctatctctacagaaaaaaattaaaaattagtcaggtgtggtggcacatgcctgtagtcccagctactcaggaggctgaggcaggaggattgcctgagcccaggaggtagaggctgcagtgagccacattcacaccactgcactccagcctggatgacagtgcaagagcctatctccaaaaaaaaaaaaaaaaaaaaaaaaaaaaagacatgaatgaatgatatacagagaaggaatagcttctccttgcaaaacaactccaattagcaaatgtggaagaaacaaaggaacagacaatcaccattaggtaagcaccacagaactgctgcaggccaatggaatgaatgctaaagatgggtaaaagttcaaggagaaatgccctattttcacagtctcaaagttatcgtccccaagatatgtattaattacaaagtgaaaagtagttactttatggtggaaaaacttggcagacatccccgtaaccaagtgattacagttaatatcaccagtaattagacaacatcatataccccatctataagcgacccactgaaatgtatgggctgagctgcagtcccctaaaactcctatattgaagccctaaccattataacctcagaatgtgaccacatttgaag

SEQ ID NO: 339745 - DNA, 883 bp, Homo sapiens
  misc_feature (69)..(69): n is a, c, g, or t
  misc_feature (83)..(83): n is a, c, g, or t
  misc_feature (87)..(87): n is a, c, g, or t
  misc_feature (96)..(96): n is a, c, g, or t
cccactgacctgcgcccactgtctggcactccctagtgagatgaagccggtacctcagatggaaatgcngaaatcaccgtctnctgngtcgctcangctgggagctgtagaccggagctgttcctattcggccatcttggctcctctccctctttaaagtgaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcacattggcatagggaacaagataatcaacagatgccaaccccaagttaacagaaatgctacaaattataagacaaagacttcaaaatagctattttaaattttgcctagtgaggtaaatgcaaacatgctcactatgaatgaaaacaggtaatctcagcagtcatgtaaactataaaaataagcaaatataaattttagaa

SEQ ID NO: 339746 - DNA, 932 bp, Homo sapiens
cagatggaaatgcggaaatcaccgtcttctgtgtcgctcaggctgggagctgtagaccggagctgttcctattcggccatcttggctcctctccctctttaaagtgattgctcactgatgccttatctagttctcttggtgaggtcatgttttcctggatggtcttggtgtttgtggatgttcatcaatgtcagggcattgagaagttagaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcacattggcatagggaacaagataatcaacagatgccaaccccaagttaacagaaatgctacaaattataagacaaagacttcaaaatagctattttaaattttgcctagtgaggtaaatgcaaacatgctcactatgaatgaaaacaggtaatctcagcagtcatgtaaactataaaaataagcaaatataaattttagaa

SEQ ID NO: 339747 - DNA, 847 bp, Homo sapiens
cagcaagggagtaggcttccatgtcttcagtcccttgccatggtgttggaggaagtcactcccttccagatttcttggctacctgagaagactctttggagcaacttagtaaacagcaatgggatttcatggagtttacagatgacatggccaccactatatatgatggagctcagtggagaattgctgattttcatgttttaactaggatgtccctgataaaagaatgggatatatgggttagcacatttgattgtacttcaggcagtcattatcactagatgccccagccaacaattagatcatttttacaaactcttgggccattgcctaggagttgccctccatcgcgagttgaattgtgtcctccagaaaagctacgttgatgtcctaacgcctcatatttcagaatatgactgtatttgtaaataagatcattgcagatgtaattagttaagataaggtcacagagaagggtgggctccaaatccaatatgactggtttctttacaagaagacagtcatgtgaagacacagagacacagggagaatgctatatgaagatgagaacagagattgaagttatggtgctacaagtcaaggaatgccttccaagctaccagacctgcaagaggcaaggaaggatcctcccctggaagcgtcagagagagcaaggcccagccaacaccataatttcagacttctgtcctacagaattgcgagacaattaatctctgttgtgttaagccacccagtttgtggtgtttgtgacagtcctagtaaaaaatatatatatcttgtttggactaaaatctctggaaatttcctacctcacagatactcaaaa

SEQ ID NO: 339748 - DNA, 387 bp, Homo sapiens
agagggaaagagtgtgcatgtgttttcgatagtttccctgggaactcttctacctgcagagctatcgtgtttcctgtggccctgatcccctatatcccctccctttttctgtgctgctttcagtctgatatccgctaagaaagaaaataacaatgcttgatagaacagtgtgtacattaacatagaactgcctctgagtaggcaagcaaggagccctgacaggtgccagggtgctgtgacaccttcctcggtggttcagacccttgtgtcctcagtcctgctcactcttgtagatggccattagcatttgtggtttcgactctttgcagggacccctgagatctgtagtatatggtgatagtgattctgccgaggcacacgtcttga

SEQ ID NO: 339749 - DNA, 633 bp, Homo sapiens
gtaatgaattaagcaggttattaaatctctgcaggctggaaacagcctttgtctatcttaacatcaccttttcattagttcataggcctggaatcctcacgggggcatcaaaaagttgtcaggaggtctctgaattctggagttggtgtctgaatttgtgcttcaggattacgtttcttgacagctcctcatgcattacacagtggaggggaatggcggatgtgtgtgtgcttgtgtgtgtgtgtgtgtgtttacaggtttctcaaacaaattagttatgtacattttctccagaggtggcatacaaataacttgtcagtgaagggtgaaaacatgcattttaggttgcgtcagccatcttgcctctgcattcataagtgggaagacaagattgtctgagttctgatttaataggtttttttaccctcatttgagactacatctctaaggagcaatcatttaatacaaacaaaactatttttctacttttgtgatttatatgtgaagatgcttatacagtaatcccctttacccatgggggatatgttccaagaccccccatggttgcttgcaagtgtgatagtacctaaccttatatatgctgtattttttctatacacccatgcctaccta

SEQ ID NO: 339750 - DNA, 265 bp, Homo sapiens
attccaaggtgcatgcgggctgtgaggtgccttagagaatacatgtgttagataacctttgtttagtcatgagttatagtgctgttgagtgggagttagatgatgatgagtcatcactatttattattatattttttgagatggagtctcactctgtcacccaggctggagtgcaatggcataatctcggctcactgcaacctcctcctcccgggttcaaacgattctcctgcctcagtcttcccagtagctgggattataggca

SEQ ID NO: 339751 - DNA, 543 bp, Homo sapiens
ttcaggcctaagagtattcaaaaacaggagggtgcggtgagagacagttaggaggagattggtaggtgcagtggagataaataaactgtagaagggctagtttgctggagagaaccagggaaatgaagagctgggaggagtctttttggggtcagaacaaatctcaaacattggcccccgaaactattcctttaaaggaacccagatttgttttgattgacctgtgaagcaatttatgcttcagcacattgttgaaaacaatggagtaatcagccagcaattggtgatgcctaacaactggatgtggtcaaagaaagaggaaaagagtgccctgccaaaaccactgtcatttcatggtgactttgggactatccaaggctgtgcctcctgaggaggaacatgaggggcttcacacagaggggagattgggagaaatatgcttcactaaaacaatccagccagtgactaaagaaataacagtaacataccccagagtggggcaatcaatatccagagtggctataatatataaaatggtcagtt

SEQ ID NO: 339752 - DNA, 259 bp, Homo sapiens
cgtggcttcccaaagtgctgggattacaggtgtgagccactgctcccagccgagtgcctacttaataaatgttaacaagaaaaacccaccccaaaaaaggaaagaggacaaacacaaggcaagggtgtttcagcagaggcaaacatcgcgagcaaaagcttgcaggtgggagaggccaaggccagttgctgaagtccttgccagctggcagggactgtgccctgtaagtgggggatgagtccagaggcaggcagggacc

SEQ ID NO: 339753 - DNA, 424 bp, Homo sapiens
ttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcaaacacaccacaagagcatcagcaagaagcattccttggttacggtgcgggtatttcagtggcagctgcagttgattaaggattctcaagccctggatgggggatgaagattggaagcacagcacccccgctgccacctttttttttttttttt

SEQ ID NO: 339754 - DNA, 449 bp, Homo sapiens
tccgtctacacatctcatccctttgtcttctgttcctgttacaactacatcttctcactcccaactactgctaactatagcaacatctccttacagtatttaaagaattattctgtaaaattgactttcatgaaaaagaaactctacatatcactgatagattaccagtttccttagttaggacatgtaaaaattcatttctcattaaaaccacattgaacttaattgcctttcactgatgagtcagaagaaaccgcatggttataataatgaatatccactaacactgttgggtgtgtggtgtccatgatggagaaagagaatgaatttccctataaatggaatttacagacacatagagaccttacaatatgcgttctttggagatcgttcttatgcttttgcacttgcactgtgacagtccagtgctcattcaagtctcttcgtag

SEQ ID NO: 339755 - DNA, 417 bp, Homo sapiens
ggaatatattaaatagtcagtaaacatatgaaaaaatgctcaccaatatggtcattagagaaataaaaatgaaatcactatatacccacaataatgtctaaaatttaaaaacaagactgtggagcaacaggaaccctcacacagatttgatggaagtgtgcattgttacaaccatcttgcaaaactggttggaagtatcttttaaagctgaacatctgcaaaccttatgacccggtaatttctttcctaggtatctatccagaacaattgcatatacacatgtataaaaaaagatatgcatcagaatttcatctacagtgttatttgtaaaaacactatactagaaacaatccaaatgtgaatttatgaaagaaagaattaatacattgcaacacggtctctcagggtaccgagctc

SEQ ID NO: 339756 - DNA, 293 bp, Homo sapiens
ggcacagagaggggaagtaactggccccaaatcacatggctgatcccccagccaggccaacaccagcagcctccctcatcagactgtgggcccacagggcagggccagtctgcctggccacctctaggtcccagtactgggatacggggcctgacacagagcactaactcaggtaatagttgtagattttttttttgagacagaatcttgctctgtcacccaggctggagtgcagtgacacagtcacagctcactgcagccttgatctcctgggctcaatgattctcccacct

SEQ ID NO: 339757 - DNA, 427 bp, Homo sapiens
tccttcccatggcaatcactttcactctgtttagctgattcttttatattacctttatgtcttaaatgactaaataatatgcctgtattcctaggaatgaaccaaaggaatgaaaaaaaaagtgcctgtattgctacctcctgatttttcaatttgaggcattttctattgacttcccccaatacaggaagtgataacttgactctttttttcccccttcccaccttaattcctcataatacacatgacatgcatcctatctcctatcttctcagggttatacatggtaacttaaattaacattcagtttctacattattatgattatacaaatactatttatagctaaggcatattattaactatgattacttttccttacttgcacatttttttttgttttccctgagtttttcagtttgcttgg

SEQ ID NO: 339758 - DNA, 420 bp, Homo sapiens
aagacccaggatcagatgagattgcccagcatctgaatgcagatagagaagcagagaggggtaccccaacatctagaagcaggggagaagagtagaaaccagaagaggaggtcgaggagacaccagtggggtagaggagaccaggtgagtggggtgttctggaagccaagggaagaaagagttttgggggaaggaaggagaggtgacccccagggtcaaaggctgcgagagaccacagtaaatcaggactgagagtggccatggaatggacatccttattttcaggtttctggagaccttgacaagtggtttccacggagggctgcagagaggaaattgagacatgatacaaacaactctttgctggagagagcagagaatggggaggtgggaggcatggagggtgcagcacagaggaag

SEQ ID NO: 339759 - DNA, 501 bp, Homo sapiens
aagcaatgaataagtaaatgggatagaacagaaaaattgggaatatcatttttttttaaatacgaagtcaacatctcctaaatgtggctgcaagtggggcaggaggcactacacgcacacctgcagtgctggagaagaaatacagcctcctctgccttagtgcctgtcttgtctcacacgtgcacaatactcataactggggacaaaacactgcctggctgcgtctcctttaacacatacagcaagatgtcgagctttatctagcttttattttttaagtatttacactgtggcactgactttccccacttgtgctgccctctagaggagcccaccactcattcactctgtgctatttggtttttaagtgcagataatggcaagttactgattgaagtaaaggaaccactaccacctcttctttaaaaggagtaaaaatcagccactttagaatgttccttctgcacacatgtgttagatccctttgcaatttttcactgc

SEQ ID NO: 339760 - DNA, 366 bp, Homo sapiens
gtcattgtttaattcaggagatccaaaactatcctgtagttccaaactacaaatgtagttaacttgggggctattgaaggttaaatctaaactcaaaatgaaggagccatgcccagagaagagctgttcaggcccgctggcagggtttgtacgtgggtggccaggtctgaccccaggcagccaggatctgggtctggtttctccatccagcaagccctgcctctggctttgctcagccctgtgtttcctgccaagcggaaatccctggtcactgacttggggagaggtcagggagggaagattcttctcccctgatgtcacccagctgtttgtaacccaagcagcagcagaacaagcacacttgat

SEQ ID NO: 339761 - DNA, 457 bp, Homo sapiens
tgtgtcccaggaaccgaagaaagcacaggttacagcaatgagcgaacacagttgtgtgtctcctgcctgcaggtagctgcggcctcgtggagaaaattgaagtcagatgattatcgtgcggggtgagaaaggagggtgagaaccaagtgctgttcactcatcattcattcattctcttgttcagggggtgtggagcactggatgggagctagacatccctctagacctgtgctggctggaagagtagccgctgccatgtatggctatttacattgaattaaaattagaccaaagtaaaaattcagcttgtgaggcacgtagccacacttcagtgctccgtagccacgcgtggcgaacagctcttgtactggagagtgccgatgtagaacattccctgcatcgcgagagctccctggatggtgctgggctgcaaaggccactcccccgggagtgcaca

SEQ ID NO: 339762 - DNA, 278 bp, Homo sapiens
gctgctcgcctatggagtagccattctttatttctttattttcttaataaactggtttcacttgtctctatggactcgctctgaattctttcttgcgcgagatccaagaacgccctctgggggtctggatcgggacccctgtctggtaacaactgcagatatctccctccaacacattgagctgtgtgttgatgtcttggaacttgctagctgtgaattaacctaacaatgccatcccccaccctgcaacccacaccctgcagctcaacggtgcacag

SEQ ID NO: 339763 - DNA, 988 bp, Homo sapiens
accccacctgctgtgtgttctcctcgagtataatgctcaggcaatcttcaatagggtatggacacagataatttcaagatttagataacatttgagaatatgaaggctcttaactggcactcactactggaactcttaggtctgccttgattctagccccactggacattgacaacttaggggaaagactgccttttagtattttcactatggaatggtatactgtatttattacttcaacacatattaattgagcacctgctatctgccaagcactgtattaggtaagtaggatacattagaaaataaaggcaaagatctataccctctaggaacttacgttctagtcaaggagacgtgaaataaacacaataagtaaaacacactttattcaaagagaagtgtgtcaaaaaagaaaaagtagacagcagaacaagagtaccaggggtcgggtaagttgcagttttatattatgtagtcaaggtaagcctctgaaatggattgttgagcaaaagcttgaaggagttgaaggaaataaagaatgtggatatttaggggaaagagtattccaggtggaggcaacaccattgaaaagcctattaaagtgaggatatgcttactgtggtttgaggactagcaagaagatgaagtcagagaggtagcaggagccagattatccatggtcattttaaggactgcagattttactcttaaatgcaaagggggcaggggagcagtgtagtgttttcagcaggggggtaacaaatctgacttttgtttttaaaggatcaaattattatgtgggttcaggaagtcaagggtggtagcagggtaggtgatgaaaagatgttagattgtgagtatattttgaagttaaaggtggcggcatttcgtgattgataggaaggtgaagaagggttgagacaaactctagggttttcagtctgagtggagctgacatcactggggctgtatttggaggagattt

SEQ ID NO: 339764 - DNA, 374 bp, Homo sapiens
ccagatgagctaacattttagtaacacctgataaaatgaaattgtgttcagcccaaaatgaagctatcaagtccattaaaaaaacaaaatttcaaaaacttgtaggggtagtcttaaacatcctggcttatgctcatgccatgaaccaagccatgaacatctgtgattactgtcttaaatcaatgaaacacatgaaaagggaaacggaatttggagacttaactgaaatatccctaatacatgctctgtcagggcagggacaaggcctgttttgcccaccactgtattcccagcccttataccacagtgccgagcacacagaggaagccctctaaatgtttgatgaataaatgactacatgactgacccatgca

SEQ ID NO: 339765 - DNA, 244 bp, Homo sapiens
ctgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttct

SEQ ID NO: 339766 - DNA, 394 bp, Homo sapiens
aaaacaataccatctattgttttatttataaaacctgttgatctagtatctactcaataataaaattcaaaacagaaaaaatcctccccatatcattttcattcttttaaacctttcaatggcctctgatgaattctaaaatgaaagtcaaaccttgtatcacggtctgttctgtattactcccactcctttacaaatttcaagtcttgctgatccctcactcagccacgttaatcttttatttacattgctattccccttcaagctcaaacagtccccagaacttcctgcagctgatgagtctgaatgtattgtcataaaatgccttccctctaccctctccctggcttctaaggtatttaccagtgattttctcttccattatcctgtttac

SEQ ID NO: 339767 - DNA, 330 bp, Homo sapiens
gcccttaagctgagtgtttgcaacccttgacttagagggccaattacaattcaggtatcttagttgctaattaagtaggtctaggatggagccgagaatttggatttctaacaagttcccaggtcatgacgatgctgttgatacaacatttggagactcattttctttgcattgacttagaaaatggccatgagacattaggttcaaaaagcaggttaacaagcaccatgtgcggtaatatcttcgttcctgcctttagtcactccttgaagcacttgtcacatcactcacacctttcccgtcaccccccatgagtcagtctttgagagg

SEQ ID NO: 339768 - DNA, 357 bp, Homo sapiens
tgaagtccagatatacagacacagaatgaatacatgagcatgtctataaagtcgactgctcagtaaaaggggaaaacacacagtttatgttgctttatgatatttttaacacagatcttcaaagttacaggttaagacaacatctgctgggtacacctaccctctaaatttttataccaagtagctcacagggcctcattccatacactgtacatgacgaaacacgctgataccaggtaccatttttattggcaccacttctgcttatgaaattgataagaaaaaaagactgtcagaatataggaattttatgctccagaattcatacaagaccgttttaaataacactcttcactc

SEQ ID NO: 339769 - DNA, 370 bp, Homo sapiens
cagggctgggggcccagaggaagcatgaggcgtcgtgggagagaggcctgggggcagcagaggaggcatgaggtggaggcctgggggcagcagaggaagcatgaagcatgagagagagagagagagagagagagaggcctggcaccagaggaagcgtgaggggttggtggagagaggcctgagggcagcagaggaggtgtgaggtgtccacgagagagaggcctgagggcagcagaggaggcatgaggcgtccatgggagagaggcctgagggtgggagaacccatcacaccacagccgcttctcctcagagatggcaccaccacacccaggcccctgtatccagcaaaacaacctttcaaaaacaaagg

SEQ ID NO: 339770 - DNA, 189 bp, Homo sapiens
aatagaaccatcacaaacactgacgcaacatcacggtcctgtcactgcttttcagagtgagcacacagtgaagtcggtttaatagtaaatactaacgcctctgaaggtgatttagccagagccaattcagtgagcaagcgccaaggattaaaaacgcctcccttccatatccttgttctgcacctgcca

SEQ ID NO: 339771 - DNA, 272 bp, Homo sapiens
ggtgtgcacatggaggtgatatctcagttcccgcatttgcagattcagttagacattgtttaatattaaacacattcccaatgcatgttgggttatattcatttggtcacttaaaggagtgtggatcagaaaaggaatgaaaacactaaaagctaaccaacagaaagattatatcaaaaacaaatcttctacgaaaaattctttcataggagaaatattccattatttccaagttcccatttatttccttcccagtccacatgcaaatacac

SEQ ID NO: 339772 - DNA, 190 bp, Homo sapiens
cggtaccccgtcccaaggatgagaaatatggtgtaagacatcacaatcccattagttcagagcgcgtaatggagtggaaacgcttgtagggcttcaccagggctggtgaattaccagatctccgtcaagtgcagtaaccagttcctcatccttcagtttctcatcttgggagcaattccgcagctgggga

SEQ ID NO: 339773 - DNA, 466 bp, Homo sapiens
cggtaccccgtcccaaggatgagaaatatggtgtaagacatcacaatcccattagttcagagcgcgtaatggagtggaaacgcttgtagggcttcaccagggctggtgaattaccagatctccgtcaagtgcagtaaccagttcaagttggaagtgtgtcttttgaatgcagaaaacaaggtcgtggacaaccaggctgggacccagggccagctgaaggtgctgggtgccaacctctggtggccgtacctgatgcacgaacaccccgcctacctgtactcgtgggaggtgtggctgactgcacagaagtcactggggcctttgacttctacacactccctgtggggctccgcactgtggccgtcaccgagagccagttcctcatcagcgggaaacctttctatttccacggcgtcaacaagcatgaggatgcggacgtgcgttggggctcctgggtcgtcgtggg

SEQ ID NO: 339774 - DNA, 775 bp, Homo sapiens
cggtaccccgtcccaaggatgagaaatatggtgtaagacatcacaatcccattagttcagagcgcgtaatggagtggaaacgcttgtagggcttcaccagggctggtgaattaccagatctccgtcaagtgcagtaaccagttcaagttggaagtgtgtcttttgaatgcagaaaacaaggtcgtggacaaccaggctgggacccagggccagctgaaggtgctgggtgccaacctctggtggccgtacctgatgcacgaacaccccgcctacctgtactcgtgggaggtgtggctgactgcacagaagtcactggggcctttgacttctacacactccctgtggggctccgcactgtggccgtcaccgagagccagttcctcatcagcgggaaacctttctatttccacggcgtcaacaagcatgaggatgcggacatccaagggaagggcttcgactgtccgctgctggtgaaggacttcaacctgctttgctggcttggcgccaacaccttctgccccagccactatccctacacggaggagatgctgcagatatgttaccggtatgggattgtggtcatcgatgagtgtcctgctgtgggcctgatgctgccatgagtccctgctgcgcacccgctctgcctggccagccctcgggccacaccgtgaccctctgtcccttccctcctggcccgctggcaactcttcaacaacatgtctatgcatcaccatatgtgggtggtggaggaaccggtgctaagagacaagaacca

SEQ ID NO: 339775 - DNA, 313 bp, Homo sapiens
cgactcacttttaatgaagagcatttagcaaaagcaatgaaatgccaattctgagattaggttatcaaagaagtctggcttccatctttccccctctcatggaaaccagctgtcctgtagtgagctgccatatggaggggccacatgacaaataactgagggaggcctccagacaacagctagtgaagaagtgaggcctgcagttcaacagtccacgaggagctgaatcctaccaagaaccagcttaacaatcctaccaacagcaagcttagaggcagatcctcagccaagcatggtggctcatgcctgtaat

SEQ ID NO: 339776 - DNA, 437 bp, Homo sapiens
atttgcaagtcctatttttccattctgtgagaaccagcattaaatatttttaaaatatctaaattcctctgactttatcacgaacatacttctttaagaagctgtgcttgcttatagtatagaggcatcaaacttgagggattaataatctcatctcaaacctccccactctattcaactatacaattttccttgataattataatatgtcaaacgtggcctttttccagtcatcaatggcttttagaagcccttcggaatatttcaatcctaatgtcttcatgcttcatcaactccagtccttaacttttctagagtaaagccactttagcaagcttacctgaactgaagcattctgccctgggataagtcattaaagtatacatcaatcattttcatcattttcttttctttttttctttctgttttgttttttt

SEQ ID NO: 339777 - DNA, 807 bp, Homo sapiens
cagccctgacagccccctgcgctgttgtgatgtgacactgtgatatcatgtcatatatagccatgtcttgctacagaatcattggcctggacctcagtgcctggagttccttacattctgaataacaattaagggtataatcctggggatagggacccaggataccggaacaggtctccaagcaaatccatttttctggggtaaggcattttactattttgaagcaccaggaagttttactgtcagccagccacactcttaactggccctggaaccaaaggcttacatttaagagatgactgggtaggggtctatgtatataaccatgtgacactaaacgacagggatacaatctgaaaaatgtgtcattatgcaattttgtcactgagcaaacatcatagagtgtacttacacaaacccagatggtatagcctactgcacacctaggcatatagcctattgttcctagactacaaacctgtacagcaggttactataccgaacaccatatgcaattgtaacccaatggtgtttgtgtatctcaacctagaaaaggccaataaaaatacagtattataatcttatgggtccacaattacatatgcagtccattgttgactgaagcatcgttgtgcagcacatgactatagtctgctgtcctgaaaaggtcagaatgaaaagttatactgagatctgactatgttcttacaaactcccctgcctgacccacttcagtttatcaacagggctagatagtagtgctcagtaatccagtctccattatctgcaataaaattttttaacttt

SEQ ID NO: 339778 - DNA, 426 bp, Homo sapiens
cctgggtgactggatagctggtggggtcccaaaccaggaaacaccgcaacacatggaaatagagatgtcattttcttttaagagcatggaggcaagtattatttacataatctcaaaagagaaaagaaacacttattgtggtattttccagaattctcaagccggggaggtagggcgagggtgcaataaagtcacacctggaaaccaggcctgagctcttgttcacgacaataaataaccaccaacatggcagagccccatttccccacagcatgcgggcctcgaagccaggcgcctgggttccaatccctgctccgtcgccaacagcacagagcagtgactgccctgggcctccctgctgcatcaacagcaccttcccagggagggcttggtgagctcacccagcctggcactcagcaccacaag

SEQ ID NO: 339779 - DNA, 276 bp, Homo sapiens
cgacacagtgagactgtctaaaaaaaagagagagagagaaaatagttgacagagagaaaatagttgagaacagttagtagacgtagtagacgagaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggg

SEQ ID NO: 339780 - DNA, 336 bp, Homo sapiens
cttataaatagagagaaaattagtgtttgccagaaattaggaattgggagtgggggcgggggtggttgtaaaaagaaaaacagaagggatccagtggtgatggaaatgtttgttatcctgactgtggtgttggatgcacagacctacatgtgcggtaaaattctacaaaaccagataaaactaccaccactgcaaacacacacacacacacacacacacacaattaatgcaagtaacattggggaaatttgaataaaatcactgggttgtaccaacatcaatatcctagatgtgatcactgtactttaattttgccaaatgttaccattggggaaa

SEQ ID NO: 339781 - DNA, 381 bp, Homo sapiens
acatggtagaagaatgttcacagcagcttcattatcaggagaatggaaaaataacttgtggcatatccacacaatggaatactactcagcaatgacaagggaaaaactatgaatacacacaaccacatgatgagtctcaaaactacaacgtggggataaaaggccagacacacaaaacataaatcatacaagtccatttagagcaagtgtaaaatcaggcaaaatcagtttgtggtgagagaaatccaatcagttgctcctaggagggatgaggatagtggaaaattgactggaaagggacacggggaagttttctgtgggaatgggaatgttctgtcttgttttgggtggtggttcacatagggtatatacaataatcac

SEQ ID NO: 339782 - DNA, 298 bp, Homo sapiens
ttccttggtaatggcattaatccattcatgaagatagatccctcatagcctaatcacctattaaaggtctcactttgtttgtagagacagggtctcactctgtcatgtagggtggatggaatacattggcacaatcacagctcattgcagccttgacttcccgggcctaagcagtccttccacctcaacatcccaagtagctgggaccacaggcatgtgtcgccacacctggctactgatttttttaattttgtagagacagggtctccctatgttgcccaggctagtcagggactct

SEQ ID NO: 339783 - DNA, 351 bp, Homo sapiens
tccagggagttttgctggtaaggaattataagagtttaaagggactctcaaatatgtattcagtttctatggaatgcccttttacagtttctgtttccataaacatattttgctttcctaaagcaagatttacccaaaatgtaaaagtgtgcaaagagttggcccttcctcctaatcatagatgtgtgttttaaaatattttaaatgtatttccttcttggtgatgtatatgttggactggtttcttgggtctgggcattatttatactcaagaacagttgttgccacgtgattggaaaagcgctattgatgtcattctcatcccatatgctttgacagcaaaggagttag

SEQ ID NO: 339784 - DNA, 417 bp, Homo sapiens
tgccctttctccttcatttgtcatgctaatgcaacccttttccactttgtacctggaatattgtgaaagttttctagccggtgacatcactagattacaaatgttctgacctctaaccctatcttacaagtcccaattgaatctttataaagcattagatgtgatgttataggtaatgaaattaaactcttccacagggcccttcagctcattcatatcctgactccaccccctccatctaactttattccccactgcaccctaacacttcatctccatctccaaggtcaaggttccttcctggccactataccacatcatgctattcctccttcctgagattttgaccactggcctctccaaacatttttgatcatacattcttatcagaatgtttttttttagatcagaaacaac

SEQ ID NO: 339785 - DNA, 665 bp, Homo sapiens
ccttcttaagctgcctcagatctagatcccacaccagttgctcctacatctggtaaaactaaggtgtcttgtaaaaataagagatctaagacagacagaccttcgctgtcaagacaaaatatcaagatgcaaatgcctggctgaaatggattaaataatccattagcacttcaaataaaagcgattattacacttgtacgcacagtaggccagaatcccagattatcccctttccactcagataaggactgtatggtggctctttttcaaaatcccattgcttgggataatccaacatactgagctctctctgctatttcctgaaatttaacaccctgcaggtcagccccctatggcaatccggcttccacctctgaatgctgaatgctgaatgcacaaagtttactttgtgcgtctcaggtcaggaggaaaatttagtgttccttggaagcattaaacgatgatggaaagagctcaagcctttccaagactttgcccatcagtccatgcttagccatccccaaacaaatgtatagtggtaagtggaagacctttactggacactctgccaaataattggagcagtacttgtgctgtaatccaattgggtatccccttcatcctggcatttcatcaatctacaaaggtaaaaacaaaacaccaca

SEQ ID NO: 339786 - DNA, 155 bp, Homo sapiens
tgtggagcagtaagggtggaagcagggaagcccttcagaaggcttttgcagtaatccaggtgacagagatgatagaacttggtggaagcagcagaagtggtgagaaatggttatcatcctagatgtattcttttttttttttttttttttttttt

SEQ ID NO: 339787 - DNA, 704 bp, Homo sapiens
ctctctccagttccccacttctgcctccatatgtttaatgacatgactgtcctaaactacttcagtatccttgttttcaaacatctcctgaaattttttcctcctctaagaaatttttctcctctgtgcaggaagggatatttttagtacaatgcagcagatggttacctttttgatacacgccaacctctgtctcttcagagcttctatgccaggtggctccagtgtagaatgcctctaaaagattcttcatgaccctaaatctaattgttccctttctgaaagaggctgaccgaattgattacatttccagacattggtagaatagatctaagtaacttcttggcaatacagcagtccactgtggagcagacatgaatatatgtatgtaagctttaacttgcaaggtggatgttgtttgtcttataaattacacaaggctaagatagacacccatgacccttgaattgttattccctgatatgttggaggacgggcagtgaaggaagagcctgaaggtcgtgaaggtaatggttgtttgctaggcttcttttctttaccacatttctttatgccaagacgttgattttaagtatcctctaaggactgagatggagttcattttataacgttgttgttactggatgatgtatctataccatagatcaaatcccttaaccataattactattataaggaaaagt

SEQ ID NO: 339788 - DNA, 552 bp, Homo sapiens
catagccccagtaaataaggccagtgactaacatggagaagaatacatctcagttttactctctacgtatccattttatcacccccagattccctgtacacgtgttcagtccctccccattttctcctccccgtccctggcaaagactcatgtttctgtcaccgtagagtcgcctattctaaacatttcgtactcacggctcataggcggtgttttgtgactggctctttcactcagcatgatgttttcaaggtttctctgcatctgagcaggcgtcagcgcttcattccgtctgatgaatgagtcacggtcccctgcacatacctggcattttgtgtatcacgcgtcctctgtggatggacatttggggtgtttccactctttggctgtgtcagatgttgcccactgctgtgcttggtggctccgccacgctcctgccggcggcccgtggtgcctccctcgccatgccctctcccgcctttcacatctgaaagcccatctggtgggtgtgaacaccaatgttctcagcagcatattcataacagcccgaga

SEQ ID NO: 339789 - DNA, 525 bp, Homo sapiens
aggctgtacagaagcatggctgggaggcctcaggaaacttacagtcatggcggaaggtgaacaggaagcaagcgcgtcttaccatggcggagcaggagacagagcgcacaaaggagaagtgccatacacttttaaaccatcagatctcgtgagaactcactcactatcacaagaatagcaagggggacgtctgtgcccatgattcaatcacctcccaccaggcccctcctctgacatgtggggatcacaatttgagatgagatttagatggggacacagagccaagctgtatcaaccaccactgcagttggcagtgttcagcagataacaagacacctgagaggtggaagcatgagaggcatcttgtctcctctagctcctcacaccttatacacaaggagagtccagtctgttccatattaaggaagaaaacatgggacaaggtactaaataaatgattaaaaattgaaaccaagacagctgccattacaagctatttgaaagcccccagagttgtaaaatctc

SEQ ID NO: 339790 - DNA, 584 bp, Homo sapiens
ctccatcagcatcataaaaggacttgttagaaatgcaaattttcagaccccatctcagacctactgagtcagaaattcaagtaatggggtcctgcaagctgtgttcacaagacctccaggcatttgatgcaccccaaagttagagaacactgtctcgggaaatacttcatatttcatttctttcattgaaaagacttaagttctcaaggacaatgatataagaaatatcatgatgtattattcagttaggtacctttgtagtcatggataaaaaaaaaatctgtgtatttgttactgatttttcttttcttttcttttcttttttttgagacggagttttgctcttgttgcccaggctgagagtgcaatggcgcgatcttggttcactgcaacctctgccttccaggttcaagtgattctcctgccttggcctcctgagtagctggactacaggcacgtgccaccacatccggctaattttgtactttcagtagagacagggtttcaccatgctggccaggctggtctctaacccctgacctcaggtgatctgcccgcctcggcctcccaaagtgctgggatta

SEQ ID NO: 339791 - DNA, 1872 bp, Homo sapiens
ctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaa

SEQ ID NO: 339792 - DNA, 1619 bp, Homo sapiens
gtcaaaccatcttccagggcattcagtttatttcattttcagacagttcccatggggtgaaaaacctatgctttcactgaaaatggttaagatgcagtcctaatcctaataaatactaacaaatcattattaatcaaaccaataacatgcttctcatttttagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaa

SEQ ID NO: 339793 - DNA, 210 bp, Homo sapiens
cactgcacccagccctatatttaactcttaactgccaaataaatttagaaaatcattgtaacatttttcacttttgcctgcaacatatgagagttccggtggtgcctcatccttgccaacatttggtgttgtcagtctttttcctgttagccatggtagtggctgtggagtggtagcccacatgcttccttgaatacttcttgactgatg

SEQ ID NO: 339794 - DNA, 523 bp, Homo sapiens
tgcagtgccacaagatgcttggcgtaaagggggaagagaaagcatagaccaagcacaactgggtttcacaaggacccctctttgccttcggagaagtcggtattggcagaaacggcacagccttgagagcctcagcggggcgccactttctgcaaggatgcccttccgttctcagttccagcagtccctgactgtccactgtgagaattccttttaacatcagagatctctttcggtaagataattatgctctcaatagctgtggatagaaaaaatatgaccgaaaggatcgatgcagtaaaattttttttttttttttttgagacggagtctcgctctgtcacccaagctggagtacagtggtgtgatctcggttcactgcaatctctgcctcccgggttcaagcgattctcctgcctcagcctcccgagtagctgggattacaagcgtgcaccaccacgcccagctcattttttgtatttttagtagagatgggatttcaccatgttggccaggctggtct

SEQ ID NO: 339795 - DNA, 361 bp, Homo sapiens
ctctgataatctctgctcctgttctttgagaccatcccccacactctccactctccaacgtgacacctgtaaagtctcttccagggatctggggctgcattccagggtctctttgctctgagctctctgaggcctcagactgttgtaataaatcaaatggcagggatcttctccaacatcatccttcttccttctgctttcctatgagggctgaaattcaatgtgtttgcagaggactccgtgtgagggtctcaagggaatttccaatttggcgcaagggaaggaagggagagagagactaaaaattgcttgatggccaccatgtgccgggtgctcccaatatagtctcaaactcatgaca

SEQ ID NO: 339796 - DNA, 385 bp, Homo sapiens
tgagaaactcgagctcggttcccagcctgggtgacagcagagtgacacctcgtgtccacgcagctaactctccactctccaacgtgacacctgtaaagtctcttccagggatctggggctgcattccagggtctctttgctctgagctctctgaggcctcagactgttgtaataaatcaaatggcagggatcttctccaacatcatccttcttccttctgctttcctatgagggctgaaattcaatgtgtttgcagaggactccgtgtgagggtctcaagggaatttccaatttggcgcaagggaaggaagggagagagagactaaaaattgcttgatggccaccatgtgccgggtgctcccaatatagtctcaaactcatgaca

SEQ ID NO: 339797 - DNA, 472 bp, Homo sapiens
cgctgcggcagtccagatcaaaaatggcggcagttggtgtgttctcggtttctcggctgctgggtcggtcccgcccacagctggggcggcctatgtcgagtggcgcccatggagaagagggctcagctcgcatgtggaagaccctcaccttcttcgtcgcgctccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcgggagatggcttaaataaataacttaaacttaaaaaaata

SEQ ID NO: 339798 - DNA, 364 bp, Homo sapiens
gtcagtgccccgacaccagaagcaccacctccctcggcccccgcgggctccccgcctctgtgctggctccaactcagacacagccaggctgggcagctccaacagtgaccatgggccaaggatcatggccagccccgagctaatgccaccgcacagaggagcccggggccacgccccatgcagccttgaagctgggtctcctcagccattggacaggctgacgccactcccgacctctctcacagatggccaggtgcgatggttcacacccgtaatccttgcactttgggaggctgtggagtgtggatcacctgacgtcaggagtttgagaccagcctggccaacaaggtgaaactccgtcttt

SEQ ID NO: 339799 - DNA, 424 bp, Homo sapiens
gcttcttgatcactaagactctgtagtactactttttgtatttatcacatgcttaatacttactgatgcacaaattattttaataagtacattaagctagtactgaaagtaagtgaaatctgattatatcgtctttaggcatcctaacaaaatccattatgcctttatagtcattaaattattcccagctctggaatattatttgctttgttaatactattctagctgaaataaaacacattatagatggtatcactgatgcaaagaagaaaaatctcctaagtcttccatctgaaagtcaataaagtgggtggaaagaaaaacaaaacattaactaaaaattgtcttaaattttctagcatacattgtttaatcttgaatttgtgacactgaagccacggctggggttgatggatgcgtgctt

SEQ ID NO: 339800 - DNA, 375 bp, Homo sapiens
tttctgctatcctccctgtcactctcttttctccaaatctctggccccttactgtctgctgagcatatcaggcatgcttttacagggcctttgcccttattgattcctttgttattttgcctcagatagtcactggtctgcctgtccaactatttgtttgtttttcaaccatcattttgctgaggtgtcccttatcaccctatttaaaaaaacaatcactcttctcacctccctggcattccttgttcctctacaccctccactttcttttcttacaaatatcaccacttgatattgataatctcactacactaaaaggtaaattccatttttgtctctttgtatcactgatgtttagaatagtatctggcacat

SEQ ID NO: 339801 - DNA, 244 bp, Homo sapiens
tagagacgggtttcaccatgttggtcaggctggtctcgatctcgtgacctcgtgatccacccgcttcagcctcccaaagtgctgggattacaggcgtgagccaccgcacccggccacacctgtagtttttacagttttacctcttacacttatctgtatgattcattttgaattaatttgcatgtgaatatccagttgttcaagcaacatttgttaaaaagaccatcctttcctcatgtgtttt

SEQ ID NO: 339802 - DNA, 760 bp, Homo sapiens
caaggccggacgcatcaccaagtgtccccgttagccaagttagcctgctgtggcagctctttactttttccccccgaagccccttcagctctgttttctctttcggggtcatgaagtttgtccacggcccctactcctgacagcctctgggatgggtgctgcggaggcagcagcagccacacagaaagaggcagatcagcgttgtcacccctacttttgtaaaaggaaatctggtattgccaggctgtgtggttagcgactcacatatgttctcgaaatctcacaaaagccctgtgaggtagaaattattttacccattttataggaaggaaattgagactgagcgagccggcttcggattggctcaaggtcacatatagtcatcattcgaacctcactcagtctgcttctttctgaagtctgtgcagcttaatcacttcagaatgggaaggaaacgggggcccagggaagttaagcaacttgcccactcactcagtctaattggtgccggggcagggacagaactcactcaattccactgctttccccagtttctggtgagtgatgtgtgcctggcactgtgtgcacctggcactgtgtgtagtaggaatgctgtttcttctgtctgtaacctcctcccagttctgtaaacaaagacaaaccatgccctgcccttaaagctatagggtcaaatgccactcttgatgatgcttcctatacacatttgtactctcatggacttgcagtaatgcacgagagg

SEQ ID NO: 339803 - DNA, 242 bp, Homo sapiens
aacatattacatggtcacatcttctcactataatgggttagagaagtgagactctcttttatttccagaaaagtatacagaaactttatattagcaatcagttgtaagaacatgagaatagtctgtgaagtcgtttaaaaatatttcaaacacatgttcatacattatcaattaacaaataactgcaaaatacacaagggagttgttatctttatacatgtgtaaatggaagaatcggtacc

SEQ ID NO: 339804 - DNA, 385 bp, Homo sapiens
tgtggcccgcgccctctttcggagcctgaactaagtcccactcttcagaagcctcttgggtcccttattctgtcgccattggcctccggagggcgcaggtctggctgtcacacgggctccctggttttgcatgggacacaccccacttgtcacgttgtcagttttactgtgatgcctcgggcttcaccgtctgctctggagctctcccaaggcagggatggcatcttcctggtatctgcggcccctacaagccccagctctcagcacagggtgtggcccgtgtttttaaatgagaaagccagatgccacatcactgttgggaatgcgatccaggcccaaagtcagaaggtccccacctgagggtgtcatgcctgttccagcagga

SEQ ID NO: 339805 - DNA, 374 bp, Homo sapiens
atctcgctgggggattctccaaggagggcacggggccacgctgtcaagaactcatctcatgtggaccgacgttccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacag

SEQ ID NO: 339806 - DNA, 512 bp, Homo sapiens
ttcaagcgattctcctgcctcggcctcccgttcgctacattagaccatgcctgtctaatttttgtatttttattagagacggggtttcaccgtgttagccaggatggtctcaatctcctgacctcatgatctgcctgcctcggcctcccaaagtgctgggattacaggcaaaagtggcttttaacttatttttcaggtgtaaagttagagactagttcctgctttattagatagtaagaagagttttgaatcaattccgtgtctttttgcaacctatccatgcctacacttccggagagacagtggccaaaatcaaaggcaaagaagcagtaacagaatgtaaacaggtggcaggcagcctgagagcaccactgatccttctcagcatatgggccagaatttaagaaaagatctagcaagggcgatgattgaccttttcgacatactccacattctagcctggagtgcagaggatgcctggtaagcatgaaaaatccttctccttactgtca

SEQ ID NO: 339807 - DNA, 452 bp, Homo sapiens
ctcaggtgatctgcccgcctcagcctttcaaagggctgggattacatatatgagccaccgtgccctgccttaatttttgtattttcagtagtcctgatctcaagtgatctgtccacctcagcctaccaaagtgctgggattacaggcatgagccaccatgccggctcagtcttccttttaatatgcccagacacaccgggcatgtggctgcatttcatcctggcctgctgaagcctttgattctactgcaggatcacaactcttgctctccagccctgttgtgtagctttttgctatctgcagcagactccctcctggcatagagcaggccctgcagaagagctccctgtcccagcggatctcctcatggcctcgtgccggatcttggcctcgtgccggatcttggcctcgtgccggatcttggcctcgtgccggatcttggcctcgtgccc

SEQ ID NO: 339808 - DNA, 603 bp, Homo sapiens
tgtgccctggcaggccctatggacgttgccaagtgagatggtgtgaaaatatgtcagcaagtggtagactaggaaactgcgggctctcgttctcctagagagctcaatgttaaagctataggagaccaaaacatcgtgagaattctagaaactagttaggatgctgcaatgccagctagtgcagagccagggagggactgcactgggaagggtagtcaagttggagcattttgcttgttcttgcccttccccctgccaggcatagcaatgctactgggagagaccctccaattcccagctcctcccatgggatgggtttctgctgggtccgactcaagagtgctgagtggtggggtctgtctgccctcagagcagcacctctgcgtttccacagctgcaaggggacggggttatgggcagtggaatagttgtgtctgggtatcctggaggggattggtgccaggacccccggtaaataccaaaacccaaggatgctcaggttccttatgtaaaatggcatagtatacctatgcaaatgctcctgtatactttaaatcatctctagattatttgtaatgcctaatacagtgtaaatgctacata

SEQ ID NO: 339809 - DNA, 384 bp, Homo sapiens
ctctcgttgcccaggctggagtgcaatggcaggatctcggctgactgcatcctccgcctcccaggttcaggcaattcatctgcctcagcctcctgagtagctgggattacagacatgtgccaccacgcccagctaattttgtatttttagtagggacgaggtttctccacattggtcaggctggtctcgaactcccgacctcaggtgatctgcccgcctcagcctcccaaaatgctgggattacagacgtgagccactgcgcctggccaacaatttaagttttaagctaaactgaaatttttatccccaggtatataattttatagataaccaagaatcaggaataaaattttctcccaggtgaaaattctaggtacattcttt

SEQ ID NO: 339810 - DNA, 272 bp, Homo sapiens
cttcatataaagatttaaaaaatgcaacattttattacatcatatggaaatatttgccaatattatataatattggatgatggactctatgacttattcattcatttcacaaatattgagtatgtactatatgtaaatattgtgcatatttacaaaaataagatgcgtattctgcataaaattgttgtaaaaaaatagaatttatgctctctgaaggtagggatttttttttttttttttttggttggattgaaaaatcttcgcggggggaa

SEQ ID NO: 339811 - DNA, 500 bp, Homo sapiens
cactggaaatactcttcagtctgctttgttctaaagtttctacttttcccagtataacctgttgaaaatttagtccttcatgagaaatacggctggaatttcttgtggcaggctggccgccggtgttcatgtagttacaccttttgttgctatttcaccactgatcaaaaaataaaattgtattttttcaaaagaaacatggaatgacatgaagaaagtccttaatatatcatggagtgaaaaacagcaagttgccatgcaaatgtcaaatagatcctatatttttaaataagcaactgcatatgtatcatttaaatatatatgtttagatatttgctaaattatgaaccgcagttacccctggggagtgaggttaggaaaagtaaagtgagattttcactttttacattatactttttactttacccacttctgtattgtttgaatctttaaaatgaacaagtgttattttgtaattaaaaaaaacaacaactgacaaa

SEQ ID NO: 339812 - DNA, 428 bp, Homo sapiens
tgttgctcggggttacctagaggatccccgtgctgcacaaatgatgcctacctccagaaacatgcacattcctgggctcatctggcctcggggactccctgaacatagggatgacctccccatttctcaagagcacaaaccacagccaggagttcagagctcacacaagatgttactattgaagaaagaagctgaccttgaggctactgcttctcttctcagtccctggggagaaaattctcttgttggcagtctatattccatattagcccaaggaaatcatatgattctccacctccatgcccccatcctcaggtggctgtctttgagattttcacctgacattctgcagctaaccacctttctatctgtcatctccctgggagacatggtcattagcagagagcaccatgtaggtgtctaattaa

SEQ ID NO: 339813 - DNA, 436 bp, Homo sapiens
aacctaacttacagggtgctggaaaaacaccgggttgtcctccactccaggatgcctacctccagaaacatgcacattcctgggctcatctggcctcggggactccctgaacatagggatgacctccccatttctcaagagcacaaaccacagccaggagttcagagctcacacaagatgttactattgaagaaagaagctgaccttgaggctactgcttctcttctcagtccctggggagaaaattctcttgttggcagtctatattccatattagcccaaggaaatcatatgattctccacctccatgcccccatcctcaggtggctgtctttgagattttcacctgacattctgcagctaaccacctttctatctgtcatctccctgggagacatggtcattagcagagagcaccatgtaggtgtctaattaa

SEQ ID NO: 339814 - DNA, 239 bp, Homo sapiens
aatcatactgaattttataggacatgtgctactatatgtgttggttatgtaaggtccttaatactgtttgaaattgtgtgtgtatgtatttcttgagacagggtgttgctctgtcgcacaggcagtggtaaaatctcagctcactgcaacctctgctgttgggctcaggcaatccacccacctccgcctcctgaaaagctggggacacaggcaaacactaccacatttggctaattttt

SEQ ID NO: 339815 - DNA, 577 bp, Homo sapiens
tcggaacacttgtgttcggctgccagccttggttactgcaatagtctcctgtttccacggtcattcattccacaaacatttactgagtgccagttatgtgtgggcaccatgctaggtgctagggttagagtgatgaacaagaaggtacttggggctttgccctctcttgttccctccaatcggttctctcaggctgagcaagagtgatctttctaagtctgattttgttggtctgctgagaacccgctggctgtcccattacccttctgataaaatccaagctcatgactgcgtctttcagagccttcggtgatccagctgttgtctccctgtctagcctcattctgttcccttctcttgctcagtctctgttctcggaatgcatcaaatttcctgttgcctcaggatcttcacatacgtgtttccttctgcctgcaatgccttgcttcccctttcacttgacatacttttggacagtctttaggtctgtttaagatgtcatttttttcagaaggcctctgttggccctcccctccaagtccgccccccatgaactgtgtcctcctgcagcacttca

SEQ ID NO: 339816 - DNA, 444 bp, Homo sapiens
tggagagcttgaggggtgagagttgtatgtgcagagacagagactgaaatgataaagcaatgtgcttaatgactaatggtgatattcggcaaaccagaatcaggaatgaaagaaccatttaatgcagcttctgaaatgatttcaaaagaaatcttttgaatactttcctatgttcctgtaataacagttgccttccatttattaaaggagccttggtcctcagtgtcttttctcctgagtaagcatttttactttagttagttttaaaatgcctaggcatgaacaccacaaatgaaagatcaaagagtaactagatgctgtctaatttaaaaaactgtactcagcaagtgcaaatccttttttaattgctaaactgaacatctgggttttttctctacttcttttcagcctgtgagttaagtgagttaaatatcctcaaacaaa

SEQ ID NO: 339817 - DNA, 757 bp, Homo sapiens
gttccgggctctgctgcccaagtctgccctgcaggtagaagaggaatcctggaatgcctacccctacacccgaacccggtacacctgccctttcgtggagaaattctccattgaaattgagacctattacctgcctgatggggggcagcagccaaacgtcttcaacctaagttcagagccaggctctgaacttaggggagagggtactatcttgatggataacttctttaggaacaaattattaagcatccatctgtaggtgtcaaagtggtgaggggttttataatcaaaattgagccactgtctcctaaggataaatagcccaaggcagatgcagacagataataatgattattagcatttattgaacatttactaagtgccagaacctttcataaattttttgtgggtataatcttatttactcctgtgacgaacccatgaagaaggtccgtatattatcccgttttcacagatgggggaatgaaagcacagagaggttaagtttctcacccagagtcccttaggtagtaactggtggagccgggattggaactggggcagtctgactccagagccaaaaatctcaaggctaatgcggattcaactcaataaaaataaacgaaaggattagctggtaggatgatgcatgagaagggaatttcaagttgcacaactaacataaagtgggaagaaagctggctttgggctgtgtcctgggctctaatcccagttctctcacttcctaactgtgtag

SEQ ID NO: 339818 - DNA, 323 bp, Homo sapiens
ctccagcccaacattactgaatgccttcttcctgtggaggggtaagccaaccccagcagatggcctatgactttccatagctctcatctctaagttccttctgtttggctaatgtactcttcctaggtttactgataagctactgatttgaccaaaataaatacatgggctctaacttctactctttgagactactttaaaaattctggcaaacgaatacatcaggaataagaattattaagaaaaaaagtcttcatacatattatcattaatctcttactttattatctgtgaaatgtggaaataaaatagatctctcagat

SEQ ID NO: 339819 - DNA, 597 bp, Homo sapiens
agtatcaattctatgccttaattttgttgataattaaagtgttaaaaattagtgagaaatttacatgtaggagcttggtctgtaagaaaatgccattaattattacacttgctgtactttttctctgattaaatctcatgatttgcttttctttctaagacattatctgttggaacattcactagcctttaagaattcccttaatttctcctgacaggtgaagtgctccctaggtatgaatttggagttctgatgatttttaaaaatccttccctgattttccagagatttcctaaggaaaattggaccaaatacagtggagaccccccccccccactttgccgtgcactttgttctagagcaagggtggcagctacaggcatttgcgtgcccctgcctgcaggcctggctgtagcgcatcatcctttgtgctccctttcctctgagctgggccagggccccatccttttccgcaggcctctgggcagcaccaggtagacaacagtgcatctctaggatggggccagctgctccatgagctggggaggtggggtcttcgttagggttcagaaggatgcctgttccttctggcctcct

SEQ ID NO: 339820 - DNA, 349 bp, Homo sapiens
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcgcaaaataacataacataatcataacaccaaagggatatacagataaccaattaagcacatgcaaagatgctgaacatcactatcattacagatatgcacattataaccataatgagttaccac

SEQ ID NO: 339821 - DNA, 4990 bp, Homo sapiens
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatgaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339822 - DNA, 4848 bp, Homo sapiens
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatgaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339823 - DNA, 3286 bp, Homo sapiens
tttggatgaaaggggcattttagctgtgatatacaactactaaacatttgtgctgcattaaataaaatgtttatttcttgttttgcagtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339824 - DNA, 2622 bp, Homo sapiens
aactaggtccagagagaccttaattttgaccatggctgtttcttggggataaactcacgcccattgaaccctcattattctccttgggtgttgcctgagatacaactactagtgactcaacataatctatgggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339825 - DNA, 5629 bp, Homo sapiens
  misc_feature (5629)..(5629): n is a, c, g, or t
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatgaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaaaaaaaaaaaaaaaaaaaaaaaaaaaaaaaaaaaaaaaaaaaaaaaaaaaaaaacaaaaaaaagggcggggcgcgtcccataaataaattacccgcaacggggggccccacggtagtgaggcagccacacccgcgttttttgtattgcaaaaagaggggcgcccccacattatagaggggcagtatacattataaaacgaagccagcagcgcgggccgacgattaacaacaacggcggccagagggaaaaacacatctacacaggaggggactaatttgtggggagaaggaccaccccactatgtccggggggcgggacacacatcagtggcggcacacaccacacccccaacagataaataacacggccccgagggggaaactaaacacaagcagcgcgcgatcgcggggaacacactcacggagaaatcccccgccgcgcgacaagaaaccttccgacgcacggagttataggagtacgaagcaatccatacccacggcggctgttactaagaataacaaagagaacgacaacaaacaccgacacgacagcaacgccagccacaggccagcgacgaagccaggcagacgtaacacagatgcgaggagccccaccgcagcaatacacaaaccagatagn

SEQ ID NO: 339826 - DNA, 1556 bp, Homo sapiens
aggatcccccttgatatgctgggatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339827 - DNA, 195 bp, Homo sapiens
cttcatttccgaccccttgtcaccgataagggcaaggtagtgtgttttctaagccaccctgagtgtcagaaatgcagaccctgacaaataaaccataaagcctgtatacataaaatggcatgatatccagattaaagagtgaaaaaaaaaaccatttataaatagatttttctacattaaaaaaagtattcctta

SEQ ID NO: 339828 - DNA, 4951 bp, Homo sapiens
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatgaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactattcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339829 - DNA, 2659 bp, Homo sapiens
  misc_feature (22)..(22): n is a, c, g, or t
  misc_feature (27)..(27): n is a, c, g, or t
gccatcgtcatagctgactctngaggntacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339830 - DNA, 2043 bp, Homo sapiens
acactcttaatggatgagttgtatggtatgggaattatacctcaataaaactgttataagaaattcagcagggcatagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaa

SEQ ID NO: 339831 - DNA, 3048 bp, Homo sapiens
cgttgttaatccaatgagccaggcgaatgagtggtagaggagtgggatctgtgtcgcagtttaaaaaaattccaccagatctaaaaacattgcagtcaaacagagagattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatgaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgctaggtggaaagcgacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcactcgtctccgaagcccccgctgccacccctggctcctcctctgtgctgggacagcacagaggaggtgacagcacagg

SEQ ID NO: 339832 - DNA, 265 bp, Homo sapiens
acaagcaatgataacacagttgtgttcccttgtgtgagtctggggtgacgttggctccttgagaaatgaaaactttatcataagaatctgtgaaaatggggaaaatgggaaaaggaggacagattcaaaattggaggaaaacaggaaaatctctcttcatcttttctaattgttcttttaatgaaatcagtactgccctttggcattaatgatcgtatgcgaaaggtaagacacattgattttggattttattgttgtagcatgg

SEQ ID NO: 339833 - DNA, 510 bp, Homo sapiens
tgaagggctttatgttccactccctgaccaggggcttcggggtgtgcaccctggcagggcaggctgcgcccacgacccaggcaccccgagggttcacaggcaagggtttcagaaggtggggaggctgaggttgtggcaaagtcataaatcagtacatggaggccgtatgtcagtttgacctgagaaggcagacatcacgacgtgtggcccatgggtcggatatagagcgtttttgatttgtgattggttaaggaggagaagctttgtccaaacaattgagatcagcagaaaagaatgttggctctggcccacaggcatgacccctcctggcccctgaggaagaaattcagaatagagccgggttcagggttcgggcctgtgatcccccctgcatttgtggtctgtgttggtagatctgtttggtgagggtctcggtttttgaaaaacaatttagggacatatgttaagatgctatttttaacttgtatagggaataaatatctcctgact

SEQ ID NO: 339834 - DNA, 416 bp, Homo sapiens
atccaggtaaaatagtgaaaattctccaaggatggggcttttatggtgctccagaactggtctgccactccagtttcagataggctgctggtttttgcagcttctgttgttgcaaggttgttggttttcaaggctactgcaaagctagagaaggggagatgggatgatggaaagtcgaaatgctacaaacctcactgtttaagttacattcatctcttagcatatggatagccaattgtcctggtgcctttagttgaaaagactattctttttcattgaattgtcttaatatctttgtgaaaaatcaatttaccataaatgtaagaggctttttaaaatgtttttttcctcttcattttcagcaatttgattatgccatgtctcttctgcacatgagttctttgttagttcaaatt

SEQ ID NO: 339835 - DNA, 285 bp, Homo sapiens
cctattcttatctttcttcatagcattcaaaacaattgactacttccttctccttgatgtctatttcatcttggcttctatggcatcgttttcttccaaatgccccccacctgctggaagctctgtttctgtttcctttgctggctcctcctctatgtgtttaacttctacatgttggaattcccagcttggttccagctcattgacttttctctaactgcatgtccactctaagtggttatatgttaatgtcacgcccccaacaaatgtacatctgctactgaa

SEQ ID NO: 339836 - DNA, 419 bp, Homo sapiens
ctatttcccatctctaaccagacccagtcacatgatccagtagagcttgccagaggttataacaatgaaaccaactaatacaatgaagactgtcccaaaattatagaatataaattccctctaattatcaatgcccaatgatatgaaagcccaaatgttaaacctcaaagtccccttataaagctcaaagtacaaaaatctagatacataaaataaaaaactcttttctcttcaatttctttatctgctcaatctcagacagacgatacatgggttctttcagcaaattctatcctatcttcctcaggaactgataaagttcccctatctcctaaagtacaaggcttcagctctgccaacaccctccccatatcaacccaccacaagcaaatctgcgcactctagctattactacacag

SEQ ID NO: 339837 - DNA, 204 bp, Homo sapiens
gggtgtgtgtgtgtgtgtgtgtgtgtgtgtgcgtgcgctgtggctgcggcgctacctccaccaagatttcaaagaatgttgcagacagccttggggcccaggaagagagttgctgcaggtgtggaaccactgcagtttccaccaggggaatgcttagtggcattgtggggatagggctgtctctgcaaccccagaacaatagag

SEQ ID NO: 339838 - DNA, 622 bp, Homo sapiens
cccaaggatctccagcccctgcagccacagactggtactggtctatggcctgttaggaactgggccgcacagcaggaggtgagctgtgggctagagctccacttcctgtcacatcagcagcggcactggattctcataggattgcaaaccctattgtgaactgtgcatgcgaggggggttgctcgcttcttatgagagtctaatgataaatgtaatgcacttgaatcatccccaaactatgcccccctcctccacttctccaggtctgtggaaaaattgtcttccacaaaattggtccctgatgccaaaaaggctgaggcactgatacacctttgaacttgacctgaatcctcttggttgcttatgtaactcagtaactatggtatatgtgagttaaagatacttttcttatgtttttagagccatgtgtttttgtatctgtgcattaaaatgctctgatatttttcagactattgtctgattttatgtaagatacatttgtttttctacagaagttttttgtcgttgttttttacttaattgcatttttttaacctttcctgtggtgctgaaaattgcaatattttttgaattgaaatttaaatgtaagaagtgagtcatg

SEQ ID NO: 339839 - DNA, 1520 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagcttttctgcataatggattcaggagtattattcccatttaattaccaaggaagatgaatcacgaagcataatgatccttcatagtactcactatttgcctatttaaaataagtcgtaaatatatattatctttgttggttttttggtagtggttggcatgctcttactatattattgaggcaatctgagaaatgacaaaggggaaatagccattaagatacaggaaattttctaaagatcatttaagagactactttatataactatgcaaataaattggaaaacctagataaaatgtataattttgtagaaaaatatgatttaccaaatgaacaccagtagatatagaaaatttaagcagactaatttatatagaaaaattatagaaagttatcaaaaaggacccctatttgaaaaaaaaagcaaaaaaccagatagttttataagaaaccctactgctttcagaaaacagatattactactgcttcttaaactgttctagaatttaaacttcaaattgtacagagctagaaaaaagcaag

SEQ ID NO: 339840 - DNA, 4295 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339841 - DNA, 4374 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagcattccagttttggtgaatttttaagcaaaagaagccacaaaaatggcagcattggaaaacagactggttctagaaaaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339842 - DNA, 4404 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtcccactgggcagcttctacatactggccttcgcacctgggctccataaccctcatccctccagcccaagaagtggtggtggcttttctgctattgataatcccagaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339843 - DNA, 3731 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctggccttacacggccactgttcacatgcgggttggaagttccaaggaacccataaaaaggggggtagccatggtcactagaatattcggcaaaaaaaaagggcgggcggacaccgagggggcaaaagggcgcaacaggaagcagaaataaaagaagacgaaactcaacacatggggagggaaacagaaaaggacaccacaggaaagaagagcgacacaaaacaaagaaagaag

SEQ ID NO: 339844 - DNA, 4408 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339845 - DNA, 4475 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggtttctgttagcaaaagtacattgtagaaaactataaaattctgaaaaggacaaagaataaattataaacagattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtcccactgggcagcttctacatactggccttcgcacctgggctccataaccctcatccctccagcccaagaagtggtggtggcttttctgctattgataatcccagaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339846 - DNA, 3636 bp, Homo sapiens
agggccgggaagccgggcgttggtggagggaggcgttgggcttctgtcgccgcgaagctggcggaaaaggcagtggccagcgagccgcctcgccagttcccacgactcccaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339847 - DNA, 3200 bp, Homo sapiens
gccagtaatacattattctggttttttttcttagagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339848 - DNA, 3190 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtcccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtcaataaatgctcaactttttatattcga

SEQ ID NO: 339849 - DNA, 1841 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagatcctgtataagaaagcactttatatatttataatcaagaatgctatttatt

SEQ ID NO: 339850 - DNA, 1918 bp, Homo sapiens
caccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtcccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtcaataaatgctcaactttttatattcga

SEQ ID NO: 339851 - DNA, 1737 bp, Homo sapiens
taaccacctctcactctacgttgagtaagtagaacattgtttagattttttaaataagtggagaatatggaaactttaatgttgaattaagaatattaaaatctaattttcatatgctagaaattggcttctgcttaaatgtttctaatttcatccccataaagtttaagtactctaaaattgttagggtctctttggtccagcaggtggggccattcagaaatcactatgacctccttcctccatgaataatggtgattaccactgtttcccaaagattcatgattcatgtcccagatgtctcctcgaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtcccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtcaataaatgctcaactttttatattcga

SEQ ID NO: 339852 - DNA, 1802 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattc

SEQ ID NO: 339853 - DNA, 1232 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctgtaagtaaaaaataataatagaagcacaatttaaaaacatgacttatgctttcctttctcattttgtccacctttactgtagattttttttttttttaagaga

SEQ ID NO: 339854 - DNA, 3658 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcctttcggaaagagggccgagcc

SEQ ID NO: 339855 - DNA, 4424 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtcccactgggcagcttctacatactggccttcgcacctgggctccataaccctcatccctccagcccaagaagtggtggtggcttttctgctattgataatcccagaggtgccttaccaccctgtttggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339856 - DNA, 4189 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcggatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339857 - DNA, 4226 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctgggatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339858 - DNA, 3821 bp, Homo sapiens
agggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339859 - DNA, 3543 bp, Homo sapiens
ttttctttttttgttattatttttatgacactccactgggctgctttgtcaccctttcattatgcctaataggactaattataaacaagtgcctaccttttattcctccttagacatggcccattatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339860 - DNA, 3552 bp, Homo sapiens
aaagatttagaaggaagatttctcattctgatgaagagctacaaaaaacctcaagctagcatcatacttaaatatcaaagtcttcccccataagattggaaacaagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtcccactgggcagcttctacatactggccttcgcacctgggctccataaccctcatccctccagcccaagaagtggtggtggcttttctgctattgataatcccagaggtgccttaccaccctgtttggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccatgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttcggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctactgtgggctggttcagttctgcattcccattccagtgtccactgccttcttgctatccctcccatctgtgcagccaccaccagcttat

SEQ ID NO: 339861 - DNA, 1697 bp, Homo sapiens
aacatttatttactattcccttttttattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaatggtaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtttttgctaaactacttaactacctccttatgaggaagtggtgagccagcctccaactcctcccccagcatacagtgacttccagctacgcagcagcagcagctcctgcctccacagtgaggcctggcagatggcagtcccccagcgccaatcccaccaggggatccaagggaatcccttgtctgagcccagcagaagcatcacaagacccccaagcatcg

SEQ ID NO: 339862 - DNA, 589 bp, Homo sapiens
atggtgggtcatttaactaagtgttaggaagaaaacaatttaaagacactaattttacagtttgcgttctgtaaaaggatacttgctggataatctaagtgaattgatggattaggtcatttgggattgtgatatatattgttcttgctgacaagaaatgacccatgaatgtctagatctatcctgtccaatattgtagctacatgtggctatctaaatttaaatgtaatttaattaagccaggcataatggcacaagcctgtaattccggtgactcaggaggcttaggagggaagatggcttcaggccaggagtttgagaccagcctcggcaacatagtgagaccctgtctctgaaaaaaaatttttttaactagctaggcatggtggcatgcgcctgtagtcccagctattctgaaggctgaggtgggaggattgcttgagaccaggagttcaaggctgcagtgagccatgatcatgctactgccctccagcctgggcagcagagcaagacccctactctttaaaaaaattaatttaattagaaactccatttctcagttgcactaactacatttcaagtgttcagt

SEQ ID NO: 339863 - DNA, 880 bp, Homo sapiens
gacctcatctgctgagtgagctgcagggccgggatccaacaccaggtgctgaatgtggagaggcaaataaaatggacacacaagccttgacctcttggagtgattatgatcaagattatgatcattgtgacacacattaatccaggaagcaaacaagtgtgaaaacagagctgcagaggtgacacttggatgccccctggccaggtggtgactagaggtcagatctcttctctagttgagtggttgtccaggttcctgggctctttccgccctgacctacaggcctgacagagccgtcaaaacatgagagccctctttctaaacatctcacttcttggaaaaaatagaatgatctgtgagtctgtgagcatagctctgcttcatgctgcagatcttcaggttggctggggtggctgagtgtgtggctcagactgaaggaacagcagctacccaaggttagctcttctcctggtgaagcgtggaaagaacagacggggtctcactctttcgaccagagtggagtgcagtggcacgatcctggctcaccacaacctccgcgtcccaggctcaagcgattctcctgcctcagctcccgatagctgggattataggcacgcaccaccatgcccagctaatttttgtatttttagtaaagatggggtttcaccatattggccaggctggtcttgaattcctgacctcaaatgatccacctgcatcggacgcccaaagtgctgggattacagttatgagccaccgcccccggccaccaggaaaagtttttaaaggggcatgtgcccctttgcagttgttattaccttcttcctgccttacacgtagctggatggctagagttccaccaaccatgttatggacacga

SEQ ID NO: 339864 - DNA, 1114 bp, Homo sapiens
gagatttgagtaacgcatgtataaactaaggaacacaaaggatttccaggacctccaaaaaggaagtatggtgttgatgagcttgagtgagaaaaaaaatggatttgggttagaagacttgggatcttgcacttaccaggtgctgaatgtggagaggcaaataaaatggacacacaagccttgacctcttggagtgattatgatcaagattatgatcattgtgacacacattaatccaggaagcaaacaagtgtgaaaacagagctgcagaggtgacacttggatgccccctggccaggtggtgactagaggtcagatctcttctctagttgagtggttgtccaggttcctgggctctttccgccctgacctacaggcctgacagagccgtcaaaacatgagagccctctttctaaacatctcacttcttggaaaaaatagaatgggtggtgttctatactatcaacaacagtaattctcaaattgctgcatatcagaatcatgtggacagttttgaaatacctagtgtccagactgcaccccagacaaactaaatctagtgaggggccatctgaaactccccagatctgtgagtctgtgagcatagctctgcttcatgctgcagatcttcaggttggctggggtggctgagtgtgtggctcagactgaaggaacagcagctacccaaggttagctcttctcctggtgaagcgtggaaagaacagacggggtctcactctttcgaccagagtggagtgcagtggcacgatcctggctcaccacaacctccgcgtcccaggctcaagcgattctcctgcctcagctcccgatagctgggattataggcacgcaccaccatgcccagctaatttttgtatttttagtaaagatggggtttcaccatattggccaggctggtcttgaattcctgacctcaaatgatccacctgcatcggacgcccaaagtgctgggattacagttatgagccaccgcccccggccaccaggaaaagtttttaaaggggcatgtgcccctttgcagttgttattaccttcttcctgccttacacgtagctggatggctagagttccaccaaccatgttatggacacga

SEQ ID NO: 339865 - DNA, 754 bp, Homo sapiens
gtatggtaggagttggagctgaaaaagtaagcaagcatcagactgtgtccatcttacatgctctgctaagaaatgtagcttcactccacagaaaggtgctgagatgcccccaaagggatttaggcaggggagttgtatctgctaactattgcattagtaatgctgcacaataaatctccccaaaagtcggtagcttaaacaacagtcttgttttctcacacacagatctgtgagtctgtgagcatagctctgcttcatgctgcagatcttcaggttggctggggtggctgagtgtgtggctcagactgaaggaacagcagctacccaaggttagctcttctcctggtgaagcgtggaaagaacagacggggtctcactctttcgaccagagtggagtgcagtggcacgatcctggctcaccacaacctccgcgtcccaggctcaagcgattctcctgcctcagctcccgatagctgggattataggcacgcaccaccatgcccagctaatttttgtatttttagtaaagatggggtttcaccatattggccaggctggtcttgaattcctgacctcaaatgatccacctgcatcggacgcccaaagtgctgggattacagttatgagccaccgcccccggccaccaggaaaagtttttaaaggggcatgtgcccctttgcagttgttattaccttcttcctgccttacacgtagctggatggctagagttccaccaaccatgttatggacacga

SEQ ID NO: 339866 - DNA, 469 bp, Homo sapiens
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatggtaaatgccctcttaaaaatataagtttatcttttaaaaatattggtacttaggctgtgttattccaaataaataaatgttcaataacaaaaa

SEQ ID NO: 339867 - DNA, 400 bp, Homo sapiens
  misc_feature (353)..(354): n is a, c, g, or t
  misc_feature (356)..(358): n is a, c, g, or t
  misc_feature (361)..(364): n is a, c, g, or t
cgtcgactttttttttttagaaaataaagtttgttgggatcttaaacattttggataaaactaacaaaaaaatatgaacacacattcaggttgtggtgctatgaggagtagcgtcatcttatttagttccttgagatacacgcacggctactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgannannnagnnnngtcgacgcggccgcgaatttagtagtagtagtaggc

SEQ ID NO: 339868 - DNA, 1958 bp, Homo sapiens
  misc_feature (1958)..(1958): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339869 - DNA, 2081 bp, Homo sapiens
  misc_feature (2081)..(2081): n is a, c, g, or t
ttgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccccaacagaatcctggatttgagtctgtcctttgaaagcatctctgctagagttcccacttccaaacccctttcagctcttcgggattcagcctccaggttgccctcggagtggagtctgtggctttccaccggagcagcgcccaggaagtgttttcgtgtgatgaaagttatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339870 - DNA, 1835 bp, Homo sapiens
  misc_feature (1835)..(1835): n is a, c, g, or t
aacgatttgcctgtgattcgtgaaacggagcagaatgcacaaacgcagcagagctccaggcttggctactgggctgccgtctgctacggcgatatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339871 - DNA, 1865 bp, Homo sapiens
  misc_feature (1865)..(1865): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339872 - DNA, 1377 bp, Homo sapiens
  misc_feature (1377)..(1377): n is a, c, g, or t
ggccaagagtcacaagctcctccaggtacttcttctctcgctccttgatggtgttctccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339873 - DNA, 1907 bp, Homo sapiens
  misc_feature (1907)..(1907): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339874 - DNA, 1904 bp, Homo sapiens
  misc_feature (1904)..(1904): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaagcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339875 - DNA, 1915 bp, Homo sapiens
  misc_feature (1905)..(1905): n is a, c, g, or t
  misc_feature (1907)..(1909): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacactgatttactcatagttttgtagtttatcacatacagcttaagtcccacacataataaaaaccgccncnnnctctcc

SEQ ID NO: 339876 - DNA, 402 bp, Homo sapiens
  misc_feature (402)..(402): n is a, c, g, or t
ttcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339877 - DNA, 582 bp, Homo sapiens
  misc_feature (582)..(582): n is a, c, g, or t
cagcacagagacggtttcggggacagaaacatcctttctcactcctgccggaatgctgctcacggctccactgaggaaagccctgcttgatggaaactcaactctgccatcatctgcagcccagtgcgacggcagtcaaaggccagggagagctatgctttgttttatagaaacatgcctagaaatggtcgccttaagttatttaacccactccctattgtcgggttttgagtttgtttctagtcttttccaactgcaaactgcactgtagtgaccattctcacagctacctcttttcacacaaaagtaataatttccctttggtagatttctaaaaataaattgctagttcagagagatgaccaattccaaggcttctgatcagctctgcccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339878 - DNA, 460 bp, Homo sapiens
acagacattcttaatggatagctgttttgtgggaagcttttcccttcccctggaacttaatgcgtgatttcccagagagctgaaacatacgattctgggaattctcttgttccctgacataataaagagtgattgtgagtgggaagaactttatgggggtcagtcataaatgccgtcagtaagcgtgcctcacctattctacgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatggtaaatgccctcttaaaaatataagtttatcttttaaaaatattggtacttaggctgtgttattccaaataaataaatgttcaataacaaaaa

SEQ ID NO: 339879 - DNA, 2275 bp, Homo sapiens
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaaaaaaaaaacaaaaaaaaaaaaaaaaacaaaaacaaaacaacgaaaaaaccgaacagaacaacaaacgagaggcgtgagcacacgcacggacagcggaaacgagggaaagtagggcgagtgcgagagagagctcaagccggtaggtagaagcgagagatcgggagatggacgtgatgagcgatggacgagtgggcaggacgagagcgggagcgagagagagacgggtgggcaggtcgcgggtgcggggtcggacggatgacgcgacggagcggacgtcagaggaacgagatgggagctggaagagatggagtggatgggggcgacgagagggaggctgggttggcagcc

SEQ ID NO: 339880 - DNA, 2206 bp, Homo sapiens
  misc_feature (2206)..(2206): n is a, c, g, or t
ttgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccccaacagaatcctggatttgagtctgtcctttgaaagcatctctgctagagttcccacttccaaacccctttcagctcttcgggattcagcctccaggttgccctcggagtggagtctgtggctttccaccggagcagcgcccaggaagtgttttcgtgtgatgaaagttatttttcagtgctgtacaagcgtcttgaattactctggtagcttttccagaaagacccatgacttcaccacatttctcgagttacgatgaaggagccgtggtttccttctgctctctcctgggaggcgcacacccctctgcacccagagccaaggagggcaggcagccctgggaccctcttcaggcaccgcagccagggtctgtgttacccacaggtgtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaattaaaaaattggattttaataaaaaaaattn

SEQ ID NO: 339881 - DNA, 1913 bp, Homo sapiens
  misc_feature (1866)..(1867): n is a, c, g, or t
  misc_feature (1869)..(1871): n is a, c, g, or t
  misc_feature (1874)..(1877): n is a, c, g, or t
agcggagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatattttttgannannnagnnnngtcgacgcggccgcgaatttagtagtagtagtaggc

SEQ ID NO: 339882 - DNA, 237 bp, Homo sapiens
atggaaattgaaatatttgagatgagactgaatgatctctaaatcctaaaagagaaaactagagaaacattaaagatgaaagaataaaatattctgttatagaaagctgtaaccaaaacggatcacattagaacttacctcaagaaaaaggtgcattaacagaatagttgtattgtcacccaaaaattacctggtccgctccctgcctgggaggtcaaggtaagatggactcaattc

SEQ ID NO: 339883 - DNA, 456 bp, Homo sapiens
atcctgagccgggcgtggaaaagctctttgcagatggcgcttccatctctgcgcccctcggggtgggggctgtcccatgttgctcctgctggggcctctcaggcttcctctttgcccacccaaaaggaaaaatccactgcacctccacttggtgactgacgccgtggccagaaacatcctggagacgctcttccacacatggatggtgcctgctgtccgtgtcagcttttatcatgccgaccagctcaaggcaggggcccagcccttcccccctcccctcagctgtgtccaccgctctcctctctccaagacctggtggggttggagaagagaatcatcagtcccccctccacctactgaagcgcaaacccctctcttttgggggtttaccccctctcctctgtgtcactgcaagcatgtgttctggtgctcataggcccctctctgccatctcca

SEQ ID NO: 339884 - DNA, 2845 bp, Homo sapiens
  misc_feature (2553)..(2553): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339885 - DNA, 2915 bp, Homo sapiens
  misc_feature (2623)..(2623): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggtctgaggaagccttgccgggtggggtgtggcaggctgggggctgggatgtgatgggtgtctctgctcaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339886 - DNA, 2761 bp, Homo sapiens
  misc_feature (2469)..(2469): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgtgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339887 - DNA, 1712 bp, Homo sapiens
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggcgacgtggcgtctgtccacgtggcgtctgtccacgttggcgtctgtccacgtggcgtctgtccacgttgaccgtctagtccacg

SEQ ID NO: 339888 - DNA, 1602 bp, Homo sapiens
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcaggtgggcctgcaggcagagaggg

SEQ ID NO: 339889 - DNA, 307 bp, Homo sapiens
ctgcatccagccctgagcccaggtcctgtggcagcttcagacagctcccttatgccctcccctcccagacacgcaggcgatcggtcttgtggagaaccagagtgactggtacctgggcaacctctggaagaaccacaggccctggcctgccttgggccggggatttaacacaggtggggacagtggtgaggggaggcaggcggggtggtctgctggtccttgggcccctggggctgggtggggcaaagaatgctaggaagtcccccaggaagaacattgctgtgaaaagaaccctggatgaagagac

SEQ ID NO: 339890 - DNA, 432 bp, Homo sapiens
gccggcattcgagaccctgcgctaccgcttcagcttcccccattccaaggtggagctgttggccttgctggatgcgggcactctctacaccttcaggtaggagaggctacttctctgcccactccactcacttgcccacactggcccccactacccacgagctcctagcctcagcctggctcccacccgaccctgctgcacaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggtgaggagggcaccttgctgcctccacctttga

SEQ ID NO: 339891 - DNA, 3197 bp, Homo sapiens
  misc_feature (2553)..(2553): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaacaagagagggggcgcgcgcccatcaaaaagatcccccccgcgggggcccccacatacagcgccgcccccccgatttcgtggagcaaacgggggcgcccccactaagggcgaggcgcactacattacatacacccgcgacgcgcctgcgcgccgccgcgcttgtattagaaacacaccggtgtagcgacaacgggcgcgagcaaaaacaagcggctaccacacgcggggcacaactctctttggagaagccagagaacacccctctctctctttcctaggcggggaggcgaaacaccacaaattggtggggagccaccaaatcaccaccctctatcaccaggaatcgaggactatatgacgcagcaccctctcaacgcggaagagataaacaactagatatatcgttctttcacgcgccggagtatatccaccgggggtgtcatcccaaaacccagcggctgggcgaacaaatatggcacgctgccctggagcgagccgaagaaaacaaaaatactgtgcaccgctatcgacagagagctaaatttgacgcagtgcatgtaacacaaacaacaacttttttctccacccccggggacactaccacccgtgtacgcaagccaa

SEQ ID NO: 339892 - DNA, 2740 bp, Homo sapiens
  misc_feature (2448)..(2448): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339893 - DNA, 2839 bp, Homo sapiens
  misc_feature (2547)..(2547): n is a, c, g, or t
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctggtgagaggcctgggagcctgcctggcctgcccaggatccctgcatccagccctgagcccaggtcctgtggcagcttcagacagctcccttatgccctcccctcccagacacgcaggcgatcggtcttgtggagaaccagagtgactggtacctgggcaacctctggaagaaccacaggccctggcctgccttgggccggggatttaacacaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339894 - DNA, 1563 bp, Homo sapiens
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggccaatgttgtggggatcgatagagtcaa

SEQ ID NO: 339895 - DNA, 1273 bp, Homo sapiens
  misc_feature (981)..(981): n is a, c, g, or t
ttctcccctgctcatgggtgctcctcctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaggagaggctacttctctgcccactccactcacttgcccacactggcccccactacccacgagctcctagcctcagcctggctcccacccgaccctgctgcacaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatcaaaaaaaaaaaaaaaaaaaaaaaaaaaaanaaaaaaaaaaaacaaaaaaaaaaccaacaaaaaaaaaggaagacacagccaccaccgaacagaagcacagaagcggaacaaaagaacgcacgccacgcaacagcaccagacgttcgggcaaaatcaaagcgcacacgaacggcgaagcaaaacaaaacacacaagccaagagagagaacaaaaaaagccaaaccagccgcgacggaacggcaaagaagaaaacgcgggcaggcacgagcagcacccccgaggacccgcggagaacacacacaaaccgcacggagccaagcgc

SEQ ID NO: 339896 - DNA, 576 bp, Homo sapiens
ggcggctgcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgaggtaggtgcgcgcggccctggcggcgggagtcctgggggcgccgcccccgagcccggcctcttggacatctgcgggaatcacagtacctggcgtctgtccagcactggccagccggctggggcgcacctcgaacgtgcagctcctctgctcccgacctcatttccccatttgaaatgaagggttgg

SEQ ID NO: 339897 - DNA, 805 bp, Homo sapiens
gtgagggaggtggctcggcgcgagccgcacaacccggccgtcgggccccgccgcccagggctgagtctcccatctcgcccctcggtccgcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgaggtaggtgcgcgcggccctggcggcgggagtcctgggggcgccgcccccgagcccggcctcttggacatctgcgggaatcacagtacctggcgtctgtccagcactggccagccggctggggcgcacctcgaacgtgcagctcctctgctcccgacctcatttccccatttgaaatgaagggttggctcctgctgccccctccgcacactgttccgggctctgctgcggggtggggcagctcaacatgggtcctcaccgcctagcggagaaggggggctgctgccgacctgggcgtccctccccagctcttgcatgtggccatcgtgtgtgcggggcataactccagccgagacgtcatcaccctgg

SEQ ID NO: 339898 - DNA, 294 bp, Homo sapiens
agttcaggcttctgcctgcatccaaaccttttaggaaagatggaaccactgtctttactttttcctgtttgccaggtgtataaaacaatgattatagagaagaatatatgtgcatggagaggtcagagaactaatataaatgttttggaacctgtctcagaaatttagatagagaaaagaagacaatttggagttgaagctcttgagctccagtcctagctcttccacttactaattgagtaatcttggtaaaatcacttaacctttgtgaacctcaattttcttgcctttaga

SEQ ID NO: 339899 - DNA, 531 bp, Homo sapiens
agatttacgggtatcagatttcagcctggagaaacaaaaacaaacaaaaaaaaacacggaggacccagaaacaaatgattctaacttgctcagaaagtcatatgtgaacgcaacaataaactgctgattttctacagttttcactacatacacacagacagacacgcacacacgtgtgcatatacacaggcattggtggtttcctttcctccacactccattaatatccggcttgtgaccttgtcctgttgatatggtgaaactgggataaattcagattcacactcttagctgctccaaagtggcctcatcaatgagtgctcttctgtaaactcagggaaggaagtgaatgatgtgtctgcatgtacggccaacagaaatctcagctgtctggtctggcatgaaaagtcccctgctttatcggggtgggaggccacccccagggctgggcagcttgcctccagctagggttgtttttgttttggttgcaaagtcaccaagacctccagagaaacaaagcactgagttttg

SEQ ID NO: 339900 - DNA, 148 bp, Homo sapiens
ttggctccagcctggcagtagcaggggctgatgcaggcgagcggccccgcagtagccttggctccgtgctggctcccactctggggttctcgctgtgggcgcaggctggtgtccgtctttcctttctttatccgagtgctgagggccc

SEQ ID NO: 339901 - DNA, 3840 bp, Homo sapiens
gcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccttgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcattgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgcccc

SEQ ID NO: 339902 - DNA, 571 bp, Homo sapiens
gcagccatttcttacagatttactcaatactttctatctggttattatgcctcttattctgtaattattttttattatgaattatttatttccagatctgtctggcctataaggcctgtaggcactataagggggagtactgcgtcaccttcatctttttatccctttggccttgctccgtgcctgaaagctcaccacactggaacgtccaggtgcacatgtgccactggacaccgggatgttgccggatgctcttttggacgctggaatgctggtgcattgttgccggatgctggaatggtgcacgcacgctctgttggacgctggaatgctggtgcattgttgccggatgctggaatggtgcacgcatgccctgttggactctggaatgctggtgcattgttgccaaatgccggaatggtacacggatgctctgttggacgctggaatgctggtgcattgttgccggatgctggaatggtgcacgcatgctctgttggacgctggaatgctggcgcattgttgccaaaatgccggaatggtacacggatgctctgttggacgctggaat

SEQ ID NO: 339903 - DNA, 5567 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339904 - DNA, 5648 bp, Homo sapiens
gcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccttgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcattgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339905 - DNA, 5765 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcggtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgactaacacagca

SEQ ID NO: 339906 - DNA, 5554 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcggtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgactaacacagca

SEQ ID NO: 339907 - DNA, 3799 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaa

SEQ ID NO: 339908 - DNA, 1338 bp, Homo sapiens
  misc_feature (1307)..(1307): n is a, c, g, or t
  misc_feature (1315)..(1315): n is a, c, g, or t
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaagaggaaggaatttgaaggcttggcacttgaaaagaaaggggcacaagtggtncttggaanaagccttaaagggtggtttgcaa

SEQ ID NO: 339909 - DNA, 1198 bp, Homo sapiens
gcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccttgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcattgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcacttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccattc

SEQ ID NO: 339910 - DNA, 5753 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339911 - DNA, 1681 bp, Homo sapiens
gcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccttgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcattgggcagcatgacggtgcgccggctgtcactgctgtgccgggacctctgggcgctgtggctgctgctgaaggccggcgcaggtgcgtggggcgcgggcgggtcctcgcctccccggaaggtgttgtggggcgacagtgcggggacgccgggcgggggtggacgttctgggcccagccctgtcctcagaggctgctggggcagaagcccggggctgggggatgccggggatggatgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtggggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgtt

SEQ ID NO: 339912 - DNA, 5093 bp, Homo sapiens
agcaaatgactgagctcgggagagatggttctgcctcaatctgtgactcgaggtggttggtgttaggctgagaaataagaacacaccaaaagtgcctgcccttccgtagatgagagcaggttctgggactgcggggatggggctgccggggcccccgtgtgccatgcctctcacctggtattgcagaaatggcatcatgaatatgggggatcgctctcccaagaggttttctgagggatttcgtgggcagccggcttcccacctgcacacattaacggcggcgtctcttcctcactgcagcctgcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339913 - DNA, 5175 bp, Homo sapiens
accacgggcggcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339914 - DNA, 5039 bp, Homo sapiens
tgtggtcactgcccaggaggcgccggggaactgcagggcgctcgaggccagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339915 - DNA, 2547 bp, Homo sapiens
tgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 339916 - DNA, 1718 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtgagtggccctgggtggagccggcagccgccctgatgctcacggggcctcctgtgcctgcgccctggtcccagtgccgggagctgagccgtgccacccagttgactttggcttaatgcagaaaagtctccgcttgccaggtggagcctgtgagattaagtcaggctgagccttgaaatgcacgattgatgactgcgtcattgtatagaaaggtgattgaaa

SEQ ID NO: 339917 - DNA, 1045 bp, Homo sapiens
gtggggggggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcattttgttcatggagtctgctgcttctgagcactggggacacgtcgcggaggccctgccattccttcctccgggttctgcacacaccgcggtgaccacctcccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctttt

SEQ ID NO: 339918 - DNA, 359 bp, Homo sapiens
aacatagtgagatcccatctctgaaaacaaaattctgaataaaaataaacagcccaccctgtttcaggtatacctcaactgtcaaatcacttttaggcagggtgttttgttatttttgttttgtttcagagtgttgtttaactttatttttgaaactgaatttgtctagaaaagaatcatattcaccttttggtcttagctactcttcatttttataaaatacatcaagttgatgcttaaaattggggatctagttacagatgaaatttttcctttcaaaagagagttccccccagttttgctgtagtcttaggagatacttaagggaggggaatcatttttagttccccctaggtgag

SEQ ID NO: 339919 - DNA, 182 bp, Homo sapiens
atcctcctctcccttagggagaagtgcagcggtcttggggccactccacactggggcgtctgggctggaagtcaccccaggaagcacctgtgggcctggctaatcagggcccgatgaaggacacagacttctaacccccaaggccctcagaataactgggtctggcttcctgggtccagctg

SEQ ID NO: 339920 - DNA, 529 bp, Homo sapiens
taaataggatctgggttatggagaccccatagtctcctctctaagagagagccgaacaataataaatattgcagaaggatttgaaacttcagagctcccgaaaaaagatgagcctcataaatcaagcaccttcctttttcaaaaattgcatttacatattttctgaaatgtgacttttttacatatgtatttaattatataaataaacatttttagtcacctggattgaaccaaacattctaatgaactatgctaattggctggaatgccaacaaaatcaaaattaatgttaaattttacttttaaaaaaaacctcagggaatcagcttgctcaaggatggaatatgtatattttctttaaagcttcaactttaataaagtaggatcatccaaagagcttctgatccaggagatcaattttagagcccaaagccaaatttaatccacataagatttttaaaaataattttatttgtaaaatgatcctatggtaaaatggacctcttgtgggcatataggcctatagatt

SEQ ID NO: 339921 - DNA, 5542 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339922 - DNA, 3685 bp, Homo sapiens
  misc_feature (5)..(5): n is a, c, g, or t
  misc_feature (84)..(84): n is a, c, g, or t
  misc_feature (87)..(87): n is a, c, g, or t
  misc_feature (105)..(105): n is a, c, g, or t
  misc_feature (135)..(135): n is a, c, g, or t
caggncatgcagcttggggaccggcgaaggcggcgttgtaaagcagccttcaagctgaaagaaattgcacggcgggagaaacancancgatggacaaggcgtgancaaactgatttttatcgagtggtgtctacntttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339923 - DNA, 5217 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339924 - DNA, 4678 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattcctagcctctggcagagcctgttcctggccgaactgtggatacagctggagggtcaggaactgttaccttctttccccttggcattaataaatttaagttaatcctt

SEQ ID NO: 339925 - DNA, 1237 bp, Homo sapiens
aagaagcaaaaactggttaatatgagtttcggtacaaaatcattgatcttaactttagtatcagaatgtttcaaccagctaagtccagcatttcctccttcccattaccaccaatcaagcctagtatcgctgtgcttgttttgcctcttctaaggtacattcagtaaaaaagcattgtaagctaggactctgttggctttggtttcttttcttttttcccctttctttctttttattatcttctattccctcctcctagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339926 - DNA, 4228 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattcctagcctctggcagagcctgttcctggccgaactgtggatacagctggagggtcaggaactgttaccttctttccccttggcattaataaatttaagttaatcctt

SEQ ID NO: 339927 - DNA, 3078 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaaacaaactgatagcaatcgaaggggtgtctaacgttggacgtggaactatgacccatgagacacaatgacaggaccataaggagatacgctatacgcactataggaacgacaaagacaacagaagaaagatgaaaagaccagaccaagtaaatcgcaagggcatacgaggggcaatggagccggacacagtaagacgacataaccccagcaagatggagatgaacacagcggaagcaaagctggtcactggagacaaacactgaagaagaagaggcataaagacagcaaaa

SEQ ID NO: 339928 - DNA, 375 bp, Homo sapiens
catggtgaatctgcaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacgggtgagttgcatgtcttgggaatactatgagttagagaaagtcggccaaggtacctggtattttaagggctatatatgaatagaagacttttattgaaagtcttcaatatgcctat

SEQ ID NO: 339929 - DNA, 432 bp, Homo sapiens
ggccattctcgtgtactgtcttctacactaccgtggggatgaaaatattaaaggcttcatctgggacttgattagcccagctgaaaatggcaagacaaaagaattgcagaatcattcaggtaattatcaactctttactttatgtttttctataggttaatctaatccttttcaggtccaagggtttttctcaatccaagtctttgatgtctcccctttcccaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaagtaagcatagaattagcagacattttccacctcaaacttctacagtgttac

SEQ ID NO: 339930 - DNA, 398 bp, Homo sapiens
gactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaagtgagtgcatgtgacaggctgttggcccccttccctatttccccctctcttctctttcccttttctaaatgcatcctcttgagagagatttggattttgatttgataaaatgtcaaaagagtgccattctttgggcctttattc

SEQ ID NO: 339931 - DNA, 3649 bp, Homo sapiens
ctagggtgaggccggcgtgaatcggccgaggcagaccaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339932 - DNA, 5941 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcggtgagtggcagtcccatccagcaagatttaaagtcattcctttggtatttaagctgcatgagaaagagaaagcatgacatactgtgtcatcgtttctgtatctgcaagataagggtaataattaataatacccagtcttccaacctcacaattgttgtgatgcccaaaataaaataatgttgaagtactttaagtgctaggcaaatatttactattgaactattatataaaccacctaatattttttggagagatcccacttaatggcagttttccactaggatgaatcctttatctatgtaataagtgtttattatcaaacaaaagacactagtactttaataattactccagagaagatttctattcctctaggataactgattttttctattgcagtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339933 - DNA, 4541 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtactctagaaatgggagggtcatcacactgcggtgttcaacccgggttttgccagg

SEQ ID NO: 339934 - DNA, 1837 bp, Homo sapiens
gacgattagattgtctttttattcccaataattgatgaaggcagtgggactgggggaatggaaaatactagagtcatttcatgactaccattggccctgctccccctccctccctcccccaaagaagagtatgtgctcatgggggtggattctgggtttgcagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcggtgagtggcagtcccatccagcaagatttaaagtcattcctttggtatttaagctgcatgagaaagagaaagcatgacatactgtgtcatcgtttctgtatctgcaagataagggtaataattaataatacccagtcttccaacctcacaattgttgtgatgcccaaaataaaataatgttgaagtactttaagtgctaggcaaatatttactattgaactattatataaaccacctaatattttttggagagatcccacttaatggcagttttccactaggatgaatcctttatctatgtaataagtgtttattatcaaacaaaagacactagtactttaataattactccagagaagatttctattcctctaggataactgattttttctattgcagtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 339935 - DNA, 788 bp, Homo sapiens
ctgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgagggaatgcttggtatatacctgaacttctgtagtacctgtgtttactttccggatgattctccttggggacaatggatgcattgactcaaccaac

SEQ ID NO: 339936 - DNA, 837 bp, Homo sapiens
gaacatttaaccacagggccagcaggctggatcttgatatgtgtttcttagttggaaagattttggactatagagaaatgtcttctcaattcttttaatttcattaaggtggtcatttttcttcttgtggcctctggaatgtgacacagaactcaagggacaggaaggagatgagttggaggctgggacaggggtccctgccagggatgctggtgactcacgtgacggtgttgatgtgtggagtccggtgcctggtttggggaatgttcgtgggatatgttccaaaggactgacggacctatcaggtactggaggtgaatggtcaagtctgatctcagggctgacagtgtcaggcaaggacaggaagttggcattggtctcattggctgaggttgttgggacccagggggcaatgtgtgccaggacagatgggtctggggctaggaaggcaggtttgggctggcgacccgggcatgggaggcatcccaggtagacagtggttgaggctgtggaaatgaccgcgattgcctgggatgagagtggagacagacaagatggaggttttgctttaagcctggggagcccacctcccaggttcaagcgattctcctgcctcagcttcccatagtgggctgcgatccccagctacttgggaggcttgagcgcgggagaatcgttttgcaccctgggagaccagaggttgcagtcaggccgaggatgaaccactgtgacttcagcccagcctgggtgaacggaagcgagactctgtctcaacacttattcactaaattacattaaattctgaatttaatttaactattatttcgtcaagacaag

SEQ ID NO: 339937 - DNA, 483 bp, Homo sapiens
aggatgagtatcctattccatagacacagattcttcatatcaaactgttcattgaggagtgagttggggaagcactttgcagctatggctcttcattatttctggagtctctctgcctgtctggcatatacagccaaatgtgagatgtcagcccatatgcttttcgggtacactcttcttgaacattggagagaaagctctttgcaaaattctaggaaacaatggaactctgtaagtgggggctgtgggttggatgtgactgaaatcagttagaccccaaaatctgggctcaatttgacacaggctatcggaattttcctacttaaggtggagagatctcaggtttgccaagagccatgtttgctgaggtgtaatgttgacttacagtgaagacgatgacccatctatgctcaatgcctgggatgcttcactgaatgaatcttactagttgtgaattcgaagtgggatagcttaacaggttaa

SEQ ID NO: 339938 - DNA, 227 bp, Homo sapiens
ggatcaggcaaagacctcccagggtcgggggcagctggtgggagcccagcgggcagagcagcagtcattggaggacaatttgtcaggcgtgtagggtggcagcatggaggaggaagccgggcacagagatggcatgggggctccccaggggagaggagtgtggccagagaagtgacaaccagattgaagttggtgatgagagagagggaggggcaggaggcagaagg

SEQ ID NO: 339939 - DNA, 245 bp, Homo sapiens
ggcaggagggaggcgcgtagggtggcaggagggaggtgcgtagggtggcaggagggaggtgcgtagggtggcaggagggaggtgagtagggtggcaggagggaggcgtgtagggtggcagcatggaggaggaagccgggcacagagatggcatgggggctccccaggggagaggagtgtggccagagaagtgacaaccagattgaagttggtgatgagagagagggaggggcaggaggcagaagg

SEQ ID NO: 339940 - DNA, 2789 bp, Homo sapiens
gcggccgcggcggggcggcgcgggaaccgggccccggggggagtcggccgggctgctgctgctgctgctccaggtgctgccgcccggggctacggcagggccgggacgccggggcacgcggggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccaaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339941 - DNA, 1661 bp, Homo sapiens
ggaacattggcaaggagagcatatttgaggaggaagttggagtgctgtttgtgatgctgggcagagaggcttataacaggagcctgtgcgttcccccaaacttcatccctaactacttgttccagctcttctgtgactcctgaactatgactctagccttggcaccccaagcaaggctcataaatgtttcctagcatctcagaatcccaggggttttcagcagaaatcctgaagtagtccagctgttgctcatctcatttttggggggtacctcccactgtttgttttttttgaatgttctggttttgcttttgtctttacctggtctggccctgtcatccccagccccgagaaaaggtctccagaaccgctgagaggtcagggctggcccaggaccctcacagctcccagtgagatctgagcctggtacctgtgtcagcagcccatgtggggccccagccaagctgctcactctggtgctgtctccctgttgtgtctcccaccaccttccctgctgcgcctgcccctccccgccccgccccggagtcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339942 - DNA, 1024 bp, Homo sapiens
ggaacattggcaaggagagcatatttgaggaggaagttggagtgctgtttgtgatgctgggcagagaggcttataacaggagcctgtgcgttcccccaaacttcatccctaactacttgttccagctcttctgtgactcctgaactatgactctagccttggcaccccaagcaaggctcataaatgtttcctagcatctcagaatcccaggggttttcagcagaaatcctgaagtagtccagctgttgctcatctcatttttggggggtacctcccactgtttgttttttttgaatgttctggttttgcttttgtctttacctggtctggccctgtcatccccagccccgagaaaaggtctccagaaccgctgagaggtcagggctggcccaggaccctcacagctcccagtgagatctgagcctggtacctgtgtcagcagcccatgtggggccccagccaagctgctcactctggtgctgtctccctgttgtgtctcccaccaccttccctgctgcgcctgccccatgcgcgaggcagagtccaataaactcgtgctcatctgcagactcctctgtgatcccctttctcttgctcgtccctcctccccggagaacggcactgatgttgctggacacaaccagaggacctctggttgtgggcttggacacgagccttacgcaggaaggctgggctccaccagctaaacacagacctcaatgttatgcaccccctggttacaaatggccgaaggttgtgcagcagaattactgaccagttcggtgatccagaccagtgaaaataagatcacggaaggaggtgcaagccaaaacaacacccaagaacaaacaaccaaaaacacacaaaaaaagacaaacagcaacacaacacaggaacagcaaaacacagaaaaaccagacgacaagaagacgacacgagaacgacgacagaggacaaagcacaaggccgaaaaaccacaagccacagaccaccaaaggcacgagcacagaagcgcacaaacgga

SEQ ID NO: 339943 - DNA, 2713 bp, Homo sapiens
gcggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339944 - DNA, 1664 bp, Homo sapiens
  misc_feature (39)..(39): n is a, c, g, or t
  misc_feature (45)..(45): n is a, c, g, or t
  misc_feature (47)..(47): n is a, c, g, or t
  misc_feature (53)..(53): n is a, c, g, or t
  misc_feature (60)..(60): n is a, c, g, or t
  misc_feature (63)..(63): n is a, c, g, or t
  misc_feature (87)..(87): n is a, c, g, or t
  misc_feature (90)..(90): n is a, c, g, or t
tcggggctggggatgacagggccagaccaggtaaagacnaaagcnanaccagnacattcnaanaaaacaaacagtgggaggtacccnccnaaaaatgagatgagcaacagctggactacttgttccagctcttctgtgactcctgaactatgactctagccttggcaccccaagcaaggctcataaatgtttcctagcatctcagaatcccaggggttttcagcagaaatcctgaagtagtccagctgttgctcatctcatttttggggggtacctcccactgtttgttttttttgaatgttctggttttgcttttgtctttacctggtctggccctgtcatccccagccccgagaaaaggtctccagaaccgctgagaggtcagggctggcccaggaccctcacagctcccagtgagatctgagcctggtacctgtgtcagcagcccatgtggggccccagccaagctgctcactctggtgctgtctccctgttgtgtctcccaccaccttccctgctgcgcctgcccctccccgccccgccccggagtcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339945 - DNA, 1847 bp, Homo sapiens
gcggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339946 - DNA, 1107 bp, Homo sapiens
ctgactgggctggcagggatagctgagaaggacaacactcatcaacagaagcagaggtccgtcaggacatggaggatgcacacaggaggatgctgggggaggggaggggcctggtgctgggtgggcacaggagtatgtctaccccaccagccacctgacctttgtcctggcaccctgaggaaccccctgccccaagcagagccagctctggaaagagccacctacagacagacagaatctgcagacttcataccattcttgccagccggtggtggtccggtttgggaggaggggttatcccccgcctgggcagcccagagcaaggcagagggcgtgctcttccctggggcagggtctccctgggcctaggcttgggagatgccaggtccgtctgtgctgccacctgcacctcagaggagcctccttcccctccagcctgtgcacctccctctccccaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339947 - DNA, 2644 bp, Homo sapiens
gcggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339948 - DNA, 2699 bp, Homo sapiens
ctgactgggctggcagggatagctgagaaggacaacactcatcaacagaagcagaggtccgtcaggacatggaggatgcacacaggaggatgctgggggaggggaggggcctggtgctgggtgggcacaggagtatgtctaccccaccagccacctgacctttgtcctggcaccctgaggaaccccctgccccaagcagagccagctctggaaagagccacctacagacagacagaatctgcagacttcataccattcttgccagccggtggtggtccggtttgggaggaggggttatcccccgcctgggcagcccagagcaaggcagagggcgtgctcttccctggggcagggtctccctgggcctaggcttgggagatgccaggtccgtctgtgctgccacctgcacctcagaggagcctccttcccctccagcctgtgcacctccctctccccaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 339949 - DNA, 582 bp, Homo sapiens
aagtttctgaattaaccttctttttacataagagatgggttaatttttgcaatggagtggccttataagcttgtttcctgcctatagatgattggaaatctaaaggcctattttcactttctactgtctctgttcctcttttattattatgatttctttaaaatcttgtggatttcctatgaatcttattgggattcactccagcagacaaaagccacatccaccttttctatcgcaagtcttatgtgaggctactgtgagaaaacacacttaagatccctagaagccctattgtttaacatagtaagcctaagaagtattcccttaagacctctagatatccctttatctaattgaaaggttttgtgaggcattgtcttaaatctttctgaagtcggccaggcgcagtggctcatgcctataatcccagcactttgggaggccgaggtgggcggatcacctgaggtcgggagttcgagacgagcctgaccatcatggagaaacctcgtctctactaaaaatacaaaattagccaggcgtggtgatgcatgcctgtaatcccagatactagggaggttgagg

SEQ ID NO: 339950 - DNA, 548 bp, Homo sapiens
ggtaccacactcctatagatagtagtttttgttttgttttgagagctgttgcccaggctagagcgcagtggcgtgatcttggctcattgcaacctccacctcccgggttcactccattcttctgcctcagcctcctgagtagctgggactaaaggcgcctgccaccacgcccagctaattttttgtatttttagtacagatggggtttcactgtgttagtcaggatggtcttgatcttctgacctcgtgatccacccacctcggcctcccaaagtgctgggattacaggcatgatcctggccatttacttctatatttctaactaatatatgggaattcataattttttcagtttcaggcatcatgtatctacctctcaccatgtgtggaagaggatcttgttctctttcataacactgccatcattcccccaagtacatttttattttcacatctccgtaatatatttatatctcagttttggttagatcaatattcagtgtttatattagtgtaactctgtgattattatttacagctgatctata

SEQ ID NO: 339951 - DNA, 371 bp, Homo sapiens
ctcaaataatcaaaaataaaattaccataaaatacagcaatctcatttatgaatctatatctataatatgcaacacaggacctggaagacgtatttgaacagtcatgtttattgtattagtattcacaaaagtcaaaaggctgaagcaacccaaatgtcttaatttggaaacacattgaaaaatgtaatacctaaatacaatgaaatattattcagcctcataaaatcttgtcacatttgaagataaactgagaatattatgtcacctgaaataagccagtaacaaaataatgaatactatataattccactaatatgagatattttaagtcatcacactcataaaaacacaaagagaaacggtgttgttg

SEQ ID NO: 339952 - DNA, 115 bp, Homo sapiens
tagttttttctttggttggctgtagtcacactgggaattactttattctctaatattgctaaagaaaataaatgtaaagcaagaagagagttactacattagaaggactggctac

SEQ ID NO: 339953 - DNA, 532 bp, Homo sapiens
gatgtgaaattacttttgaacattgttcatgggctgaggttacttttaaaaactaagctaataaccactttctcaaagaatgtggtatggcttacaataaaaggtagatttacaatagggctgataaaataaaaacaaaataaaggtcatgaaaggagaatgtggcaagttatcaccttcacatagcccaacaagttttctgagtatgagcatgtaatttagctctaagattcctggcagacaagatcaaaagaaaaaaagaaacaagtaatatgtaattattatctcatggccaaaggctactactccttaaagagaggaatattatctctgttaataaattcataatagaatgtatcacatagaacactttatagaagacactgaaggatacagtagacgtggcccaaaatggtgcaaattaggattaattcttgcaagggctgctgctttcactatgtcacttatatctggaaagttgagcagtttttcaatttcctaatatatggaataagaatgctgggtcatgtct

SEQ ID NO: 339954 - DNA, 697 bp, Homo sapiens
agttttcaaaataaatttggagggaaaaaaactaacaaatacaagtgttttcaaaaggttgaaaaaaaatgggacaacttttccaaagtcattattttgaaatccagaaccttccaaaccattaacgttccatcccactcaaatttctttggggtgcctttggtgctgtttcttaggaaggtgcagattagagttaagagtggactctatgagctgtggacctacctgttaatattctaaaggagtgcgtgacctaaaaaaatcttttaagcggctagaaatagcatctcaaggaaagtagccctgacagcaaaggaattactaactaagctactttgtgggatgtgagaaaattcacagcaaaaagaaatttgccaattcaaggatttatggggcaaggggcccaatactatgagtccaacagaaaaagggacaaaaaggtgtatgttttatttatttacttgagacggggtttcactctgtcacccaggctggaagtgagactccatctcaaaaaaaaaaagtacagatctgtgtctatttactagtgacgaaaagtgtggtcatggaatatggcaatgtacagttccatgaccttgagctaacaacttaggattgcagcctcaggttttacatttgtaaagcgaagagcctataaatggaagccctgacctttcttctttttcatagattacac

SEQ ID NO: 339955 - DNA, 514 bp, Homo sapiens
ccatcaattgtccgcaccttgaagaggaagctgccactaaactcataaagaggaaagtgtctcatcataaacagaccaacctcaggcccagatgagacaagcatgcaggccccagtcacaggggccctggtcacatgggcagcaaatggaagaggcaggccttgaactccagcaagcagagcccagggctcctattcccaacaaccatgctacactatcagcttcaggtcctccaccaggatggatcaggaaaaaaagagttagaaaaaagaatgaaggccaagccaggcggatcgtttcagcctaggagtttgagaccagtctgggcaacatggcaaaaccacatctctacagaaaatacaaaaatcagtgggcatggtggtgttcgcctataggcccagctacttgggaggctgaggcaggaggatcacttgagcctgggaggtcaaggctgcagtgagccgtggttgtgccactgcactccagcctgggtgacagagcgtgaccttgtctc

SEQ ID NO: 339956 - DNA, 308 bp, Homo sapiens
acaccttggcctcccaaagtgctaagattacaggtgtgagtcactgaacccaggcctacatatcatttttcttatgcttaatgcgtccaccaacaaataactggataaacaaaagtggtctacacatataatggaacagtattcagccataaaaaggaatgaagttgagatacatgttacaacatggatgaaccctgaaaacattatactaagtgagagaagccactgacaagagatcacacattgtgtaattcaattctcaagaaatttcagaataggccaatcctggccgggcgtggtggctcatg

SEQ ID NO: 339957 - DNA, 1221 bp, Homo sapiens
aggctgaacagttctgagagggaggcatggaaatgcagcatgaggcaaattcgcatgtaggacagcaaattagatgaaaattaggttgaagggagaagtcacaagatccaattattttgttcaatgtagtgctttcaaatcactcaaaagaccaaaaaaagttttattttgtcatgtgagcatgtgatcctggatagttaattgctttgcaaattgtcattggtaaaatgctttggaggtttttatgtaagagttacaagtaaattaaaatagtttgtgccacaaagaaactttggtgcgaaacagaacaattataatttaaaagaggtggggcagtatgagaaagcaactaatttggtattaaaggtttgaagactggaattctgtacagtatgctgggagactcatcagaacctcttccctgttgtaaataatgttcttgtcagttaatgcctaattgctgctcttgcctagaaatccagaagctttggagataaggaggtctctctgaatccagttccacagtatatcagcccctttgttcaccccatagactgtacccttcccaagggcggtttgttggcaagtctgtctggtagggcggtgttttctgcatagtaatcaggcctctgcaattgtgatattcctccccttccccctaaactctttgggttcttgacacacatggcaatgccactggtataacagaaagtcagaaggagaaaaagagaaaatgtcttctcgagttccaagtgtctgcacagccttgccagactatgattaaggcttatctacaggagactgcatgaaaaactttcttcttctcttcccaggaagcaagcagccttgtgaacaagcaggttcagaaagccaggaactgacaaacttttctagtccttttgccagcctgttctgcttttaccaagagtttagtgacaggactacctgttttcaatagttaaaatgtatattttgatcacctttagcacatgctaccttgcacagctctttttaaagccttatgtattctagctatttgaccactgttgtgtgtgattttcatttttgatgcctgatgtgacaggagggggtgaggatgggggtcccataaagatgcagagtaagttgaagaagacaatgcttgtcctgccaccagatgtctcttgtttttatttttgtttttgttttgttatgtgtaaaaacaaatgaacccttgggata

SEQ ID NO: 339958 - DNA, 266 bp, Homo sapiens
atctcccataaactcagagcaagaattcagtcattgccatcgggacggcaccaagccattgtcaaagggatctgcccacatcaccaaaacacctcccaccaggccccacctccaacatcagggatcacatttcaacatgagatttggaggggaccaacatccaaaccataacaagacagaagttatagaaaggggtctccaaaaataccacccaacacttttattgcctcccattggccagaacctggtcacatggccacaactca

SEQ ID NO: 339959 - DNA, 562 bp, Homo sapiens
ccaaataaggaagggggtggggtggataaaggactaaacaaaattaattaaaatttagaaatttttctctcagaaggaattcatgcccataaaacaaagaccaggatacattcgtattttatcggtaaataccaatagattataaatcacttttctcgtatacataattgtgaaaaaaaaaaccatccaggtatgcatgttatttattcattgagaggatatacatctctcaggtgttttttgtcgtatgtgtacttttgtgtagtctgcctgtttattctttttgaataggatgatatgtacaattaaaaaaaatcttttgtgaaatgtggttttcttaaatacattattgcatttcatacacagtgatgaagggaaaaactacaaagctagacagattgcaaattagtattgcagtagtgaggtaatagagcaatacccaaatgttttcttaaaatatatgtaggtgatgcctgtgttctttacttttgtgtgtgtgtatgtgtttttaaacaagattcattgtagtcttttagatataatttaataaatttaggctgtt

SEQ ID NO: 339960 - DNA, 366 bp, Homo sapiens
ttgctcccatcagccttgtacaccctgctcagattccctccgtgcctttctgctttctctgtcttcattcacagactagtatgaatgacctggcgctgctctccactaaatgtgatctggtgtcagggaaacaaaacagacaatttgatgacagtgtttttagaagcaaaagccctgggaattttggggtcataggtgagggccagaaaaaggttcctagactattgtggtttagctttgcaaaaggagtgaccactgggactgggccagttgtatctggaagcccatgggagggggaggtagggttttaagccagttgatcggatttatattcagaaagttaatgtggctactgggtagaggatg

SEQ ID NO: 339961 - DNA, 208 bp, Homo sapiens
gaagaaatagaaacattgaacaaagcagtaacaagcagtgagattgaaacagtaatttaaaaattgccaagaaaaaaaagtccagggccagatgtattcacaactgaattctatcagacattcaaagaggaatttgtaccaatcctacttaaactattccaaaagataaggagggaaccctccctaaatcattccatgaaatcagtat

SEQ ID NO: 339962 - DNA, 615 bp, Homo sapiens
ctgatgctggtgtgagcatgtttgctttagaacacatggactcttaagctcatgatagataatttcctaggtgagctagtatactgtttcttgaaattagtggccttgatcagcccttctctctccaagcctgtccaataaagataagtttacagccttctttttgaatagacacatgtcctctgctgaactgaattatctaaatcagtcctatttagtctcctccccttacaagaaagatccttatttcagactgaaagactaggtgatttgggccatattttaggttttatcatacttacccttcatgtcatttgttaaggtcaagttcagcatttgactgtggacataatttttagtaggtgttccttgggaagaggcttattgggaagagaagtttattccaatagtctcataaaatcagtgaatgctttgagttaatttatcagcaacctgtgctgaataagcaaggtgccatgtgttaaattaggaaaggtaacgtgctgctagtgaaaactgtgtcttctaagttggctttaaaataaattgtttaccagattaatgtttcaatcaaaaattacaattctcatttttaagatgcagctttatccacat

SEQ ID NO: 339963 - DNA, 161 bp, Homo sapiens
atcgggggactgagacatgagcatgacagaggacttcccagaggcctgagaaagaggtccttctctcggggaagttccatctgccctgagatctcgtttcaagctcctgtgggtcgggtggctgctcacttacgatgtccatagataacatcgccatctct

SEQ ID NO: 339964 - DNA, 108 bp, Homo sapiens
aaattcaacatgaaaggtaactttataaatgatttgtgatgaatcattgtattttacataactgtttctaaattaactgaagagccttaatgtcatttgttaggtggg

SEQ ID NO: 339965 - DNA, 2876 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339966 - DNA, 2889 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339967 - DNA, 2525 bp, Homo sapiens
gcggccgctactactactactactactaaattcgcggccgcgtcgaccaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339968 - DNA, 895 bp, Homo sapiens
gcggccgctactactactactactactaaattcgcggccgcgtcgaccggctgcgagaagacgacagaggggggccatggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtgtaaggaaactggaatttctcttcctcttttgtcttgaatgttttggacacctacatattgtcccatgtcctagaaaccagcagctctgtccagttactgagcacctactgtaccctaggcaattgttaccctctccatgtgagtccactacgtctctactaaaaatacaaaaattagccaggcatgatggcaggcgcctgtactcccagctactcagggggctaaggcaggagaattgcttgagcccaggaggcggagattgcagtgagttgagatctcaccactacactccagtttgtgtgacagggcgagacaccatctcaa

SEQ ID NO: 339969 - DNA, 583 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggtgagccctgacaaatctgtgtcccagagtgtccaactggctcggcagggaggctcattcctctagtcccggtgctctgggaggtcaaggcgggaggatcgcctgaggcctgggcaatatggggagaccccgtctcaactagaaatagaacattagccgggtgtgttggcgtgtgtctgtggtctcagctacatgttaggttgaagcagaaggattgtttgaggccgggagttggaggctgcagtgagctgtgatcgtgccactgcactccagcctgggtgacagagtgagaccctgtctcaaaacaaaattaataataaaacaattttaaaagactgccca

SEQ ID NO: 339970 - DNA, 3002 bp, Homo sapiens
gcggccgctactactactactactactaaattcgcggccgcgtcgaccggctgcgagaagacgacagaggggggccatggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339971 - DNA, 3039 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgagaccttgattccaaccactgcccggaggaggtagtggaggcgagcccggtgttaatgagccccgaaggcccaagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339972 - DNA, 2799 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaagggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagcaaaaaaaaaaaaattgaagtgcctggccagttgcagtgggtcacacctgtaatcccaacactttgggaggctaagatgggagaactgatggaagccaggagttcaagaacagcctggccaacatggcgaaaccccatctctactaaaaatacaaaaattcgccaggcatgttggcacacacctgtaataccagctactcatgtggctgaggcataagaattgcttgagcctggaggccgggtgcagtggcttacgcctgtaatcccaacactttgggagtctgagacgggtggaaatcctgaggtcaggagttcaagaccagcctgtccaacatggtgaaaccccgtctctactaaaaatacaaaaattagctgggcgtggtagcacgtgcctgtaatcccagctacctgggaagctgaggcaggagaatcgcttgaacctgggaggcggaggttgcagtaagccgagattgtgccattgcactccagcctgggcaacaagagcaaaactccatctc

SEQ ID NO: 339973 - DNA, 967 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtctgaggccagatacaacggcgttacccgctgaaaaacaaaaaaggggggcc

SEQ ID NO: 339974 - DNA, 782 bp, Homo sapiens
ccaccacagcggtcgagcactatgctagtaggatgcctgggttaaatctggccgaggcaagtagagctccgtcctgacgcgccgcctcccgtgggctccggccggctaagccgcggcggacaactatgctgaaagccaagatcctcttcgtggggccttgcgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtgtaaggaaactggaatttctcttcctcttttgtcttgaatgttttggacacctacatattgtcccatgtcctagaaaccagcagctctgtccagttactgagcacctactgtaccctaggcaattgttaccctctccatgtgagtccactacgtctctactaaaaatacaaaaattagccaggcatgatggcaggcgcctgtactcccagctactcagggggctaaggcaggagaattgcttgagcccaggaggcggagattgcagtgagttgagatctcaccactacactccagtttgtgtgacagggcgagacaccatctcaa

SEQ ID NO: 339975 - DNA, 334 bp, Homo sapiens
ctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatag

SEQ ID NO: 339976 - DNA, 367 bp, Homo sapiens
ggggtttagcctagattatcattcctaattcttcactaattcttcaatccctccttaacaggattttaattcatgccatttgctacataaccttgtaattcctcctactcgaaggggaggagtatatttcaccatgccatcatgtttggttcggctcatgatctgttttggaaatgacacgtgagaatgagacaggggacccacacatactcaacactctatgagacaatgtattagtccattttcatgcttctataaagaaatacccaagactgggcaatttataaaggaaagaggtttaattgactcacagtttcacatggctagggaggcctcaggaaacttacaatcatggcagaagacgaag

SEQ ID NO: 339977 - DNA, 391 bp, Homo sapiens
gagatggagtctcgctctgtcgcccaggctggagtgcagtgctgcgattttggctcactgcaagctccgcctcctggattaacgccattctcctgcctcagcctcccgagtagctgggactacaggtgcccaccatcacgcccggctgattttttgtatttttagtagagacaggttttcaccgtgttagccgggatggtctcgatctcctgacctcatgatccacccgcctcggcctcccaaagtgctgggattacaggagtgagccaccgcgcctggctgtaaaggttttaacaaatgggtgaatgccttaagacttttagcaacaaaagattggaataaagtaatgctgcaaatctaagcattttcatttacaagtcagtaattttgg

SEQ ID NO: 339978 - DNA, 332 bp, Homo sapiens
atgtgaatttttattcataagaactagaaaaatacgtcatccagatcatctgaaagatcacctcagaataaaggcatcagcaactcttgaatgttttttgatgaggatttagtgattgaaataatgaaagttttattgtaaatggtttcccattattagtctgttggataggatacagaagactatattatagaaatggtctgatattatcattgttttctaaaatctattaatagtttgttgaataaatgtgtgagtgtctgaggcaatgataggaaaacagtctagctgcatcactggaggtcaaatcctgtctcccctacttccttgct

SEQ ID NO: 339979 - DNA, 952 bp, Homo sapiens
gtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagcgaacagtgaacctacccgactaaaaaacaaacagcaacctttaattggatcccaaatgactcacagaaagttgaagatctccatgatggatcgcgatggcgaaagatgaaggtctctaagaagagccaaccagagaagttagtggcccgggctatgggcgccggaaattctgacggctggccctggggggccgggctcacatggtcatggtgcgcaacatccaagagtggaagccgggtccgaaaacgcgacacagagggggccccacggcccgaaaagtcaccagaggcgacaa

SEQ ID NO: 339980 - DNA, 660 bp, Homo sapiens
ggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgac

SEQ ID NO: 339981 - DNA, 1492 bp, Homo sapiens
attctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatattagccgggcgtggggcagtcgcgtgtcatcccagagactcgggaggctgccgcaggagaatcacttaaacccagcaagcaaaggttgcagtgaaaagacatggcgcttttgcattctagcctgggcgacaaaggcgaggcttcgtctcaaaaaaaaattgatcaggagatactcctgttctgtgttggcaagatcctgtaatcctagcactttgggaggtcgatgcatgaggctttcttcagctcaggagttaacagatttgcctgggcaacatagaactcgtctctgcaaaaaaatgaagctaaccaggtgtgacggcttgcgtctgtactatcatttactcggtaggctgaggtggtaggatagcttaaactctcgggctagagactgcaggaacatgtgaatacgctagtgcaattccagcctgggcaacactggaaagggtaggaagagtagtctttgggtccctaaagatcacctgataacaagtttgacttttctgagcactcttgtggagtttgttgtggagggaataccatgggcattggcaatgtaaagttgatctaaaaaatctcgttttccgccgtgcgcggtggctcacgcctctaatcccatcactttgggaggccgagacgggcggatcacgaggtcaggaggtcgagaccatcctggctaacactgtgaaaccctgtctctactaaaaaaatacaaacaaaattagccgggcgtggtggcactcacctgtagtttcagctactctggaagctgaggctggagagtcacttgaacccgggaggcggaggttgcagtgatcagagatcgcgccactgcactccatcctgggcgaaagagctagattccatctcataaaaa

SEQ ID NO: 339982 - DNA, 117 bp, Homo sapiens
agcagaaaacagtttacttttaacttaaaacccgagagtttagattgctactattgctagcatgctagagggtagcattctattaatagtttctgggccaggcgcggtggctcatgc

SEQ ID NO: 339983 - DNA, 194 bp, Homo sapiens
ttggcctcccaaagtgctgggattacaggcatgagccaatgcgctcggccacccagggctctttcaatgatgctgacttaaagctttctagttataaagccattttgcttttatggagaggttagacatgaaatgagagttgagccatcttactttctctgtcttctattaacatgctatcgtgatccctaagc

SEQ ID NO: 339984 - DNA, 400 bp, Homo sapiens
atataaaacacacatacacatatgcacacacacctcaaacatcttcccctgcctcagttcactatgtgtgttatgagccatacacattcacatctgttctttcaacttttcattgaatttcagatatccctttctccattattcatattacaagctgcactctgcctgatgcccatttctacaagccaacttcattcaagatgaagtgccttattaatggttatattcatgcatttcataaccatttaacatgtataatgtcttgctactatttttatgaggttcccatcttttttgatgtgtcattgttgaagtttttgaacgtggtaccccaaccccatttttcccataagccctgtggctgtgggaatttgcaaaatttgcatagcatggtgatgtt

SEQ ID NO: 339985 - DNA, 261 bp, Homo sapiens
gaaggatggagatttggaagacatgaatggatgaagaaccaagtgcgtgagggcacctatcaggattattgctgaaatccttatggagttaactggctgagaggaaggcaagcaagcgaggactgatgggcccttggcactgtgagaacagtggaggaggagggagcagggttcataaggaggagcacaaacagaaagttcagtggccccaataaaaataacaccagaatcttccagatactttctccataaggcgaaaag

SEQ ID NO: 339986 - DNA, 112 bp, Homo sapiens
gaccagtgaccctgagccagtcctcattgctatgttcagaagagacaaaggcaatgttagcatagtgaatgttgaactgggctgggtgccgtgaaaatgatataaggcagaa

SEQ ID NO: 339987 - DNA, 250 bp, Homo sapiens
cctccataaatagctgtcccactctccatctctccaaccggctctattcttcacagcacttattcccacatggttcttccactagaccataactactagaaagtaactagaatgctgtttttggtttttgtttttgtttctgttttagacatggtctcattctgtcgcccacagcccactgcagcctccaactcctgggctcaaggatcttcctgccacagtctccagagcagctaggactacaggggtg

SEQ ID NO: 339988 - DNA, 921 bp, Homo sapiens
ttgtaattgtaaaagtaatgtgaaggtaatatttaatgttttctcaaaagctagtgcccataaggtaacattttagtcatgaattttttgctggtgagacaggacccatctcatcccttccaacctaatcccttcttaaactacatcaggctgcgtttccttgggttcttcacctgcactcctctctaactcattttcttccctctttcaggttacctcatccttccctaccttgtctgcctagtaagctcctaatgatccttcagatgcctcctcctctgtagcattctcaatgctctgcacctccaaaattaaccgttacttcactgtgttcccattgcacagaagttcttaactagacgtcacatcagaatcacctaggacacttttttttaatagacagaaacaggaccctatccagaattgtcaggagtgaagtacatacaaacaaatgatttttaaaaaaatgttctcgttactactcggctacctcttctagttaagggcattgccatggggcttcagcctttgagataattacttcattgtcctcttgtatcagactgttgctgatgcaaagtctgatgtcaatataagtctcattgctttgtagttaatctgtttctgataggttttagagtcttctctttgtctgtaatgatctgtagtttcagtgtgatgtggttaggtatggtttttgttttgtgtgtgtttccggttggctctttcaatctcacaatctatgtgttccttcagttctgggacattctcagtcattgctctttcacatactgctttccctttccttccttctggaactcgtgttaggcaattggagcatctgagtccgtcttccatgtctctttaactttttctttggtacttttcatttctttgtactacattttaggtaactcctca

SEQ ID NO: 339989 - DNA, 162 bp, Homo sapiens
agtttgagaagcactgacccagcaaatgctttcatcactgtgtcttaataagagccagtgtccacgttggccatgttctaattacatgttggcactcagggctgccatcaccccagtcattcaacaagcatgtatgaagtaacctagggccatcaccttgag

SEQ ID NO: 339990 - DNA, 158 bp, Homo sapiens
caatctactgatgagctgtccaccaataagatgtggtctcatttgacatttacaaccttttataatcctgttgtaatgaataattgcttccatattgcctttttttaaaagttctttgaaattaactgaagatcccttttttccctgtccttcgctaa

SEQ ID NO: 339991 - DNA, 870 bp, Homo sapiens
ctccatccatgttgctacaaaggacatgatctctttcttttttatggctgcatagtagtccatggtgtatatgtaccgtattttcttcagtctactggtgatgggcatttaggttgatgccatgtctttacgattgtgaatagtgctgcagtgaacatacatgtacatatatctttatggtagaatgatttatattcttttgggtatagacccaatactgggattgttgggtcgaatggtaattctgttttaagttctttgagaaatcgccacactgctttccgcggttactgaactaatttacattcccaccagcattgtataagcattcccttttctccacaacctcaccagaaaccagcatctgttatttcttgacttttattaatagccattctgactggtgtgagatgatatctcattgtagttttgatttgggtttctctagtgattagtgatgttgagtattttatatgcttgttggccatgtagcttcttttggctagggacctgtgagtctccctaggtttcttgcacttactaagccttcaacaaatggtagaagagtcaattctcttggtgtttcagaagaaaacaatatcacagcccctctccactggataatactataaatcttaaaatgaattttcattcagagtaataaacacaagccaaagaactttgtataacatccgtcaactttttgtgttatctatttcttttccaaaacattgcctctggttttaaaggtaactgcccacagtgtttcactaataacattttaagcattacaagttcaacactgaaggtcaaatgacaacgaactttcagtgcttccaaaagcaggggcagagggcaactgctgagggg

SEQ ID NO: 339992 - DNA, 564 bp, Homo sapiens
  misc_feature (16)..(16): n is a, c, g, or t
tcagccggcaccttgnaatgggcacagaaattatttgggctatgtggagcaagctgtcttgcataaaaagctatattgggctctagagaaagtgagaatggaaagaatttgagagatacgtgagaccaaaaaaaaaaaagacacaattaagaatgttgaatagaatacaatgacaagaagcctttccaagacagtaaatccaaaaagcctgctaaatagcataagacaggaaaaagataaggaagcaaagggtggctgggaagctttaatccagagctcccgatatacaagagaggcatcaactttctttttaaaactgtttgcatttcctatcaatttctgtgcccatttcaagtaaacaacggaaagtgatctggaacataactttcagtttcctctgcagtttttaagtgctgaactactgatcatcctagagataacccactgaaaagtcttctctaatccagattttacaaaaggaaagtctttttaacatttggtttgataaaatgttttccgaagaaatactttactagcctgttttaatttctgtgcccatttaca

SEQ ID NO: 339993 - DNA, 126 bp, Homo sapiens
cgtgtcctggagtgaagaaaacaaggaagagagtatagtaagacagtccaagagaagacaggacacctgataatgtggggtcttgtaggctcgtgtagcaactgactttttttttttttttttttt

SEQ ID NO: 339994 - DNA, 245 bp, Homo sapiens
tggagatgggttttaccatgttggccaggctgggccttgtttagctttactttctgggttgtgatagtgtaagcttttaatttttatctaaatatagtagtacaacaaattagattatataaatgacaaattttgctaatatctttatataacatatcattaaaagggataggcttcatgagaaaaatcttttttacctagagaaaatattgtaatccaaaaattaagtattagctgtatatttg

SEQ ID NO: 339995 - DNA, 653 bp, Homo sapiens
tctggaagctgaggtgggaggattcctcaggcccagaaagttgagactgcagtgagctgtgatcgggccactgcacttcagcctgggcaacagagtgagatcttgtctttaaaaaaaaaacaaaagaaaaagagcgagaagccaaaggaattagctgtaggtcaggagcaaggaccagctgaagctggctacagagatatctcctaattgagtaattttcatctcatccttagaatcttactgtaagccttccatcaggcctctctggcattcaacccccgtgtgcaggtgtttgaatttgtaaacctttccattcttcaggtttcttacccataagatagggataattacaatgccttccttgtaagtcccttttgagattatatgggagttgcttatgatgtgcctggcacaccataatccctcagtaaatggtaataattcaataaaagagagaggacaggagagttaggatgaaatatttctgttactaattttgaggcttacatacttaagtgcagtggtgccgggcgtggtggctcacccctgtaatcccagcactttgggaggccgaggcgggtggatcacgaggtcaggagttcaagaccagcctggccaagatggtgaaaccctgtctctactaaaaatacaaa

SEQ ID NO: 339996 - DNA, 355 bp, Homo sapiens
tgtctcccaccgtaccttccattctctcttctgtcatggtaatagggtaataatgatagcatcgcagcttcaggtgggccccagttagagacctcatgtgccctagaaagtgcatcttcttcataactggcctttcccaaataacttgattagaatgtccacccatccattcattcatttactcattcactcattcatatatcaaatacgtatggggtgcctgttctgaggcagactcttgggaatctgagataagatagacacacttgctgcccccgtctctcctggcacgatgggggagacctgcctgtacctgtgagacgcctttattcctggtgaatccttctcagctgag

SEQ ID NO: 339997 - DNA, 235 bp, Homo sapiens
aattgtgtgttttcccctcccaaacctgcttttctcaggtcttgggcattttgttaagtggaaactacagtttcccaattgccaggccagtaatcttgagcctcctccttaaccggtctttctgctttccaaccttctactcttcagtatctttatgtagcaatgagctccagttactcttctgctcaaaaccctctcagatgtccttgcaagtggctcatgaggccctacacgt

SEQ ID NO: 339998 - DNA, 220 bp, Homo sapiens
acagcgtaaagagtacaggctttggaatcagacagaactggattataattctagccccatggcataccagccatgtgacctggttcaagttacttactttctctgaacctcaatttccataccacaaaaattggatagtgacacctataaatacatgggctttccgtgaagatgacatatgcaagcctggaacagctggatattcagtgagtgacacagt

SEQ ID NO: 339999 - DNA, 447 bp, Homo sapiens
ttggagctcagagaagttatggcccaagatggaagagcaagtctgtggcagacgaggtccaagaactcgctctcctgatgcctcagttgagaacacgttctacttcactacctggtctcccagctacccaagggcatatgaacaaccagggaattactttgggggataccagcaaggagatttggagatcctggaaattggaaaaaacaaaacaatctgtctaggacggcagagagagctggtctcatccaggacactaattcctgcccttggacactggtactcctggttctcaggcctttgaacttggacccggacttacaccatcagctcccctggttatataccaccagccttcttggttcttcaccttcagacaacagacagtgggacttcttgacctccatttccaattcccaaaataaatcttcttatatctatgcatct

SEQ ID NO: 340000 - DNA, 316 bp, Homo sapiens
cagcatgcaagtgcagagtggttagtgtatgaagtgcaagtcagagggcagaaagaaatgatgctggagaaacagggagttcagattgtgggaaatcttatgtgcaggggcaggagctcagacctagtcttgtggatggtgctgccccattgcaaaggaggcacatgttagtggggcggggtgaaggggataggaaacactagtccagggaagagggagtgaggctctgagtaggaccagaatagtaggatcacgagagcattaaaaaaatatttcagagcagactctcctcatgttggacagtaagtagtaaagg

SEQ ID NO: 340001 - DNA, 235 bp, Homo sapiens
taaattacacgcaagcctaaaaattcagctttttgggaaaaaatgtttcgcagatgtgacccataaacgtccctcctgtatttgtgtatgtatgttagaacaacctaagtttgttggttttctagtgttgcaattttcttagccccttgacctgcattttatagatatatttaaacattggtattcttttcagtcttaacagatttgatggttccaagaatcattggatttttag

SEQ ID NO: 340002 - DNA, 218 bp, Homo sapiens
tcacccaccctctctcggttcctcctaagctgcagaactgcctgccccatgacaaagacccacccgtacaattctatgaatggagcctgttcaccaaccgtagggagatagagtctcacttgggggatgccagttctggcattcttcatagaaaatgggttccaccacgtttcccgagcttttgtttatatttacccaatgtcttttttttttttttt

SEQ ID NO: 340003 - DNA, 650 bp, Homo sapiens
tcaatgggtgtgtgctgggaaggaaggctcactgtagacaaaatgaacaaactgcattttctctgtacattggagttttccagtgaatgaaagtggtgactgtacaacatggaggaagaaggttgtggccagggaacaagatgtacaaaggctgggaagctagaaggaccacagcgagttcaggggtgaagagacactgactagatcctggggcattctctgagcagtttaataagtggggcaagattataaaagaacttgaaagtgaggcagaaaaagagagaacttggtagactgggcaatgagaagccatcaagattctttttcgagacagggtctcgctctgtcacccaagctggagtgtagtggcgcaatcatggctcactgcagcctcaacctcccaagctcaagtaatcctcccacatcaagcctcccgagtagctggaaccacaggtgcacaccaccacgcccggctaatttttgtattttttgtagagatggggtttcgccatgttgcccaggctgttctcaaactcctgacctcaggtgatccgcctgcctcagcctcccacggtgctggggttacaggcacgagccaccgcgcctggccttcttggtttgttttttaaccagctgtatccattctgatt

SEQ ID NO: 340004 - DNA, 130 bp, Homo sapiens
ttttccatttctcacgcctatagaaacaccaattaaactttggaaaacaattaccacaggaaaataacaaaggcttttctatattgctattgaagaataaagaaggtaggacggaaagaaagaaagaaaa

SEQ ID NO: 340005 - DNA, 1102 bp, Homo sapiens
ggtcgaagttagagaaagggcacctgagagggccagagattagagactggagggggccccagttggagggtgagaaagattggggactggaaggttatgtctggagggggtcccagttggaggaccaggcgctaagaggattggaagggtatacctggagggtggcccagctggaagatcgcaggagtaccaccgacctgagggggacccagtttgactatgagagggtcaggagtcttgaaggaagcccctggaggggggcgcagctgcacgatgaaagggcagggggactgagaactgcagaatggaaggggccacagtcagaagtagagaaggggagggggctggaggtcagaaacttgagggggatccccttggagaagtccctggagttggcccctgagaacggagaccaaaggggaccccagtgggaagatgagaggaggagagggccagagattgcagaggagaggggagcgagggtgggggtcaaaagaagaaggggcctggaggatatagttctggtccagctgggagacacgagggtcacaggcatggagaatggagatggagggggagcccggtccgtgggccccaagagccgagccggacgagggatggagtggggagacgcaggagggcggtgtctagggctggggaatggagtcgtgtctggcaccccggtggggactgtattggaaggcagcccagaatgggcagcggcgaggagtgaacacctggctgcaggtgacggcctgcaggaaggaggcgaagatggccccagggaaccaaagaggctttgccgacccccgggagaggaggaggtggactgggaacccctggccaaattccgagcagcctgcgggccagagctggcagacctggtggctgaggagttggcctttgctaggcagcatgggacccggggtttccactggaccggagctggctttgcccttaaggacggcacctcggacttcttcctggatggggccctgacacgctgcagctgctcaattcacgccgcccgccgtctgccctgcagacacctctttgcagcgcgcctcctcactggggctgccttattccacatggacctgct

SEQ ID NO: 340006 - DNA, 337 bp, Homo sapiens
ctgccccctgaatgcacactctttctcctctgggagtctctgaagtgggtgatatcctctgcttataatatgcttccccttaaacctctactctcttcctggctagcttcggctcctctgtcacttgtccgctttggcatcacctcctcatggaagacttccttgactccccagattctcaggagcatggcaggtgaggtgctcctcccatgaatggatggagattagggagtgtgtgttattcatgcttaattcaccagtggttagctcagtacctggcacaagttactgtggtggccaaagtaataaccccccaccctgccaactaattgctcat

SEQ ID NO: 340007 - DNA, 268 bp, Homo sapiens
tccagcctgggcgacagagtgagaccctgtgtctctcacacacgcacacacacacacacacacacacacagaaaatgcaatagatgaaatgtttctggctttaactacattattctcttttgtcccttgcccccagagacaatttaaaagtttactgatgtgggaatgggagatgggagtctgggttacatgatgttcctaagggggttagacactggtctgagttcccttgggcttggcctgtggctgacactccttttcccacttt

SEQ ID NO: 340008 - DNA, 484 bp, Homo sapiens
tttactttaatttctgaatgttttgcaaacacattctttgttgacagccctagctggaaatgtttcagctcaccgtgttctgggtaaaaaacattgtcaagtctttttttaacccctcacgttagatggtttttcttggcctgcatttcagtgtccattaaccttagtgtcgtaacatcttggagttagaagcaaccttggaagccacccatccaacttcccacccagtgggagaattgttctgaagcttgcctgatcaccagcctcagatagcttgctttttaagggcattgctgtacagacacagagtaccatagtttaccaattccccataacattttgcatacattttcatgaatcttgcagaatcagaaagcagtgtgagcaattccaagtttgctaattaaattaaaatgagcacagactcttacaaaacaggttttagagtttcaggaggccttacatggtcaaagacatttttcac

SEQ ID NO: 340009 - DNA, 383 bp, Homo sapiens
aaaacagaacaaaacaaaactctgtctcaaacaaaacaaaacaagataacaaaagcaaaacccccttgcataacttcccattgcttgaagataaaattcaccacctttaatggagtctaaagagcctgaataatttaaccttttgtgattccttggcccaatcttgacttaattgccctctgaattttctttgctcttgccactcttggcttctttatttcactggatgtttcatgtatttgcttcttttggagtctttacatatattggtccttcttgaaagaagcttttacaacatttgtcctcttatagctctgctcctcctttcccaagtctctcttctttgtattttggcttaaatgtcactttttcagacagtgagg

SEQ ID NO: 340010 - DNA, 283 bp, Homo sapiens
ggtaggacgtaaccaggtagactagccaggtagactaacccaggcagatgtaacaggtagactacccaggtagacctaacattatgcacagaaacatttattgtgggaatttgtttacacataatatattctgtacataatgtttggcttcctttttttcctaaactatactaaattagaacaaatagcactggactaaaaataaagaatgtgtcaggttcctagttttagtgtaattatttgtttgactttgtaatttagactttttctgtctctatttctt

SEQ ID NO: 340011 - DNA, 300 bp, Homo sapiens
agtatccagaagatatagagaattcctataattcaataaaaagacaaatcaattttttaaatgggcagaggcagaggatttgaataaatatttcttcaaagaagatatataaatggctcatatacacataaaaatgttgaatgtcttaaatcattagggaaatgtccatcaaaaactgcagcgagatactactttacactcactgggatggctatgagaagagacagacaacgacagtgttgacaaagacccggggaaattgaaaccctcaaacactgcagatggaagtgtaaaatggag

SEQ ID NO: 340012 - DNA, 176 bp, Homo sapiens
taaagaagattacttctaagaatggctctgtgattcttataatttgtttcaaggccagaaacttaattgcagatcttctaagcatactcctgttcatgtttttatacttctaaaatgagatttattgttgaacagcaatcagattatgttgggcaaagttttgaaatatacactgt

SEQ ID NO: 340013 - DNA, 261 bp, Homo sapiens
gggccttggctcactgcctggagttttcaggctattgcacaggacgggaaacctcgtcagagcctgacagtcttgcagagttgaggaagaagagattagagtttacagaggccaaaatggccagcatttgtggagcagactaccagagaggcaggagtttcacagtcagaaggaaatctgaagagagaatccccttaagcctttgggtcaataatgatttgcaaaagcatgagaggtaactaccaaaagtggggctgggtg

SEQ ID NO: 340014 - DNA, 280 bp, Homo sapiens
tccttcaagatgaaaagacgtgtgacacaacatgaagtgcaaactgagttcattcacagaatgaatccaaatctaagaaaactacgtatatccaaattctaggaaatctaactacactgaagtcatgttaaccaatgaggtttaataaacaatgatcaatgctataaagctctcaaagtaaactgtgaaatacattctttagcagttttactgatttttatttgaatggagccaattgagtattttcttccagaaactaagttaggagtatattaaatgt

SEQ ID NO: 340015 - DNA, 481 bp, Homo sapiens
gatgggggctggtcccgggaagcaagttaggattagagggctgggacgtttagccccacccctttacccatcacatctgggaaggggagagggaactgaaggccccctgaagttgcaatggccagtggtttaatcagtcatgctcacatgaagcctccataaaaacggggttcagagagcttccaggtagtggaacatgtggaggttcctggagggtggcacacctgaggagggcatggaagctttgtactccttctcctatacctcaccttttcttctgtattatttgtgatatccttaaaataaactgggaaatgtgtttccctgagttctctgagcagctttagcaaattaattgaactgaaagagaggagcatgagaatctcacgttgaacccggttggtcttagaagttctggaggcccagacttaccactggtgtctagggggtgggcggtcttggggactgagcactcaacctg

SEQ ID NO: 340016 - DNA, 646 bp, Homo sapiens
gcagaggatatgatctcattcttttttatggctgcatagtattccatagtatatatatatatgtaccacattttctttatctaggctactgttgatgggtatttagatctttgctgttgtgaatagtgctgcagtgaacatatgcgcgcatgtgtctttatggtagaacaatttatattccttcgggtatttactcagtaatgggattgctgggtcaatggtagttctatttttagtttttcgagcaatccccacactgctttctacaatggttgaactaatttacactcccaccaacagagtatcagcattgccttttctttgcaaccttgccagcatctgttactttttgactttctgataatatccattctgactggtgtgagaccagcttttaaagtggtagggaatgttagtgggagaatgaccccgtagggtaagctcatgtgctcagattagaagacctcacctgtcacaaagaggtgtaaagcaaggcctgccaaactatcaagggaggctttgagcagttgtgaagtttgtgtgactctaaggtgactagaactagtaaaaaaaaaaagaaaaaaacccagaaccttcacacataagtgagtaatatctcaagtcattctatttatgtattctgtat

SEQ ID NO: 340017 - DNA, 418 bp, Homo sapiens
cacaaagaggtgtaaagcaaggcctgccaaactatcaagggaggctttgagcagttgtgaagtttgtgtgactctaaggtgactagaactagtaaaaaaaaaaagaaaaaaacccagaaccttcacacataagtgagtaatatctcaagtcattctatttatgtattctgtatttaccgacaaacaggtggtgggagtggagggggtcttgtgcttagcctgggattacaaagagcatggagacccacccattctttgtccgagggaagtccagcctagctccaccacccttgcttaaaacacttttggctctcccttagaaattgccctcaggagctcagagaaaattgatctaatttgtctcagtattgacctctggggtccccttctcttcatgaataaagggaagagcaggtgg

SEQ ID NO: 340018 - DNA, 380 bp, Homo sapiens
taatcacatgtttttatcctttaagccatttttcatcatcctaccccactcgctcttgcttccagtgctttttctaccataagatcatggcaattatcaaaagactgaacagttctgccaccttagtcacagtctccaattgtcttaccacgtttaatatcatgtccagaataattttaaggccatgttttgtactcttgccatcatttctagcatactggaatattaccaatgtcaagtgacaatttaaagcctcttaaaggctgggtgtggtggttcacacctgtaatcccagcactttgggaggccttggcaagtggatcacttgagcctaggagttcaagaccagcctaggcaacatggcaaaaccctgtttctat

SEQ ID NO: 340019 - DNA, 315 bp, Homo sapiens
tgagcacgttactcagaaaaggcactaaggaccgaaccgtgtcgcccaattaatatgtgtcagccctgaccatcacgtggctgtgcttgaagtaaggaagtgttattgttagatgagaacgcaaacgtggggccctgacccaagagggctggttccctaaaagaacagacaccagctgggcgcggtgcctcacacctgtaatcccagcactttgggaggccaatgcgggcagatcacgaggtcagtccaagaccagtctggccaatatggtggaacctcatctctactaaaaatacaaaaattagccaggtgtgg

SEQ ID NO: 340020 - DNA, 200 bp, Homo sapiens
tgatgtaggatgtgatgggtgctagaagaggcacacaggcagactgttacccaagttcagaggagggaggagttacttctagctggaggaatttggaaagacttagtggaggatatagcctctgctatcagctctgaaatgatatatgccaatgacagcagatagaggggaaaaggagaggagagaaggaaatgccaggg

SEQ ID NO: 340021 - DNA, 696 bp, Homo sapiens
tttatcaactcacttaaacctgcaggcagtattatctccattttacagataaggaaactaaagctcagagaggttaagtaacttgaccaaattaacacagtgaaaaaggggcagagctgggatccaatcccaggcaatatggctttatagttcatgttcttaaccactattttatactgcctctgtatttctaaactaaaagttgaaacctaccattggagatctttaaaaataaaagtaggtcattagctctttaagacagtctatgtatgtagcgacatttattaaatactgactgaataaagtacctaagagtatgccaggtactcttctagttgctctcatgtattagctcattaatccccacaacactcctgagaggtaagtattattattttcatccccattttgcagaggagaaaactgaggcatggagagggttagtatccacggtcacagagccaggatgtgacaagactggaacccaattgtctggctctagattctaaataaaagtgaaactactagcttatgaaacaaaatttgacaaacctctcaacttggttattctgacggaagaaattctaggaatagagaaccctcctggagttaccgtcttagttactagagctcagtttgtgagactccatagcttttcagaatattttatattctgaataaaaaaatgcacacaac

SEQ ID NO: 340022 - DNA, 434 bp, Homo sapiens
cgtcttttaaaaactactggcaaattttaaatgtgcagtgcactatataaataggaatgagaagagtctattcatggcaaggtaattagagcatctttggctagaatatctctgagtaaaaatagctagtctcaatgttggagtaaggtaattaagtcctgaagaataatgatgaaaaccttttgctcagataccctttcttcatttaagttcaatgccgtacattcaaataaaatctgtgtaatcaaactagcccattaagtactactgagtgagataaattgtaatacctattctatatccttgcaaaagggaaatgcatgttatctagaaacataacagcttataaattaaaaacattcatttttcttctcttttgtcttatatcaactttttgtatatttatatacataatcacctaactcctacctcct

SEQ ID NO: 340023 - DNA, 258 bp, Homo sapiens
ggctgaggcaggagaatcgcttgaacctgggaggcagaggttacagtgagacaagatcgtgccaccacactttggtgtgggtgacagagcaaggctccctctcaaaaacaaaggggggtgacacatggtacatacttgctaagggttggcggttattatcgtcatcaccatcatgatttgctctcctgagacggacccggtacagcacacagtgtgatgcttagtcactgctatgagcatcatgggtctttcaaggag

SEQ ID NO: 340024 - DNA, 365 bp, Homo sapiens
agctcccctagaagctaggactatagtgacaatggggttttgccatgttgcccaggctggtctcaaactcctgagctcaagcaatctgccctcatcggccttccaaagtgctaggattacaggcgtaagtcactgatcccagccttgcggtgtttttttaatcaagttcatatgctatcatctagaccaactcccatctcttaccattcctttggctttgtaggtacatatgctttaatcactcgctcttgtccacattctccactccttcccctctgcccatcacaaccattctgagtgtttaatgtggttcttttatttctatccattcttgcaaaatgttcattattttgggtgaatgtatc

SEQ ID NO: 340025 - DNA, 577 bp, Homo sapiens
tctctgttttcaggctacccacactttcctcactcagcttagacattccaagccttagaccttgcttggacctttccttagaagaattcacatattacttgtcctttcccggtatggcttgagctcttggtttgaaaaaaggcagcagactctcacctccttacaggagttcatcctaaaatacaaaacatttgcccttctctgttgtttagacaaacttccattgaactagagccctactcattttcccaggactggcttcccttctgtctcttgtctctcaccccaaaaactacatcatgaagaacaaaagctcctgtgtcaaaagacttgcatttcaatttagaacagtcagtttctcacacatcttaacaaaagttaaaaccatgcagttcattctctttatagcaatggcttggagacagccacctaaccacagtgttcctcccataagaagggctctaaacctaactcagttgttttcctatgggcttcaggggtttgtgatgccttccccttagttgttatgcaaaatgtaatgaacatatgcatactcttctatccagaaacccataat

SEQ ID NO: 340026 - DNA, 693 bp, Homo sapiens
cgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttgcatcacctagctgact

SEQ ID NO: 340027 - DNA, 194 bp, Homo sapiens
gggagcgaagagaggagctcagtttgcaaaggtacagagataggggcttggaaggacttgtggaaggaccaacagtggggtgttgacagaagggaggtgtttagagtttattccctggcctggggtctgccagttgtcctggctggtggtcaggagtgagggcctgccagagcaaagccctgggagaagattcg

SEQ ID NO: 340028 - DNA, 595 bp, Homo sapiens
ggtcggatgattctccaccagctccgacccgacaggggccagtggagctggaaaccctagacctcagtcccggctctgacacctgccagctgttgcctcgggaaagtcactttgccctctgagcctcggtttcctcgtctgtaagatgaggatagtaaagccttgtgttgcctcattcttgggattgggcaagaacccagcaagagagtggaaaaccaggggtttgaaagcggcattgcgggtcctcgtgaggggtcactgggatgagaggctttgcggggtagggctctgtgcaggctttggtgggagacaaggtccaaaacccacctctttcccctccgttgtgtgtctttgagtgagtcagtgagtctctctgagcctcacttttcttcctttctttttttttgactgacccaaattagatctttattgtatttttccacatatctatcattcccaaaagatcagtcagctcgatccttaatttttcttactatgagatgtccctaatacacagtctttgtataaattatccattttaagtatatagtgaattccagatgtgatcacaactgcatttctttctttttttttt

SEQ ID NO: 340029 - DNA, 449 bp, Homo sapiens
ttggtgtacaaatatcttttcaagaccctgctttccattcttttgggtacataactagaagcagaattgctggatcataaggtaattttattttcaaaatgtttgaggaatcatcatcctgtcattggtaacaactgcatcattttcctttcccaccaacggtgcacaaagattccagtgtttcctcatcagcacttgtgatttctctgtttgtttttttgttgtttgttttttgttttgttttgttttttacagcagccatcctaattggtataactcattggcttttaatatgaggatatgaaaatactacaaataataataataatggcaaacatttacatagcacttactatgtgccaggcagtgttctaagaatttaaatattaatttaatcctccccacaacccagagaggtaagtgtactattattatcatccccactttac

SEQ ID NO: 340030 - DNA, 340 bp, Homo sapiens
ttgttgatttttaattttcaaaagtaacaatagttaaatggttaaaataaagaagtatttgggaaatgttacaaaaaatgactgattagtttgtaggcaagatggcagaacgatgaataaattaataggaagcactaatgagagacagaatagcacagtggctaagagctgtagagttagtcacacctgggttacatcccagctcttgctgctttctagtttaaattatagttaactggctgggcacagtggctcacgcctgtaatcctagcactttgggaggccaaggcaggaggatcatgaggtcaggagtttgagaccagcctgaccaacatggtga

SEQ ID NO: 340031 - DNA, 330 bp, Homo sapiens
cctgggcaacaaagggagacctgtctctacaaaaaaatttaaaaattatccaggtgtggtggcatgtgcctgtagtcttgtgcaatcccatttacaatagccatatgcacacacacaaaatacctaggatatatctaaccaaggaggtgaaagatctctacaagaactacaaaacactgttgaaagaaaccatagatgacacaaacaaatggaaagacatttgcagatcctgaggtggatcactgagcccagaaagtcgaggctgcagtgagccatgatctcatctcaccaccgcactgtagcctgggtgacagaatgagactctgcctc

SEQ ID NO: 340032 - DNA, 450 bp, Homo sapiens
gttgacttgcagacatccttaaacacgcaaccaaaattcttaagatattaaatgggagacataaccgttaaggaaaatcgaaggagacattgatggactttgtcctctaagatgggcatgggcgtctttctaggcatctccctgtgatctcaccactttctaacttacttttcacttctcacttcctggctgcccccaccattgctgggaaattaagcatgttgaagtaaacaattctttgccaccacatatcctggaacctgctacgtgtagaagtggccacatgagaggtagtgtgactgcaaatctaaacctgtgagttgaaagaaactgcccaaattgcagcccctctgaaacttggaacatgcaggagcttctcccaacagagacgccagactcaccgtcctatctcagtcccatctgctccagggagggctgctcaacactctg

SEQ ID NO: 340033 - DNA, 318 bp, Homo sapiens
gtgataaaaatattctaaacttaggtcatgatataggttgcatagctctctggatatgctaaaaaccaaaatattgtagctttaaaaatgtccatttttcacaaaaggtctgatatccacaatctacaaggaatttaaaataaacaagcaaaaagcaaataaccacattaaaaagtggacaaagaatatgaacagacatgtctcaaaagaagacatacaagcagccaacaaacatatgaaaaaatgctgaacatcactcatcatcagggaaatgcaaatcaaaaccacaatgacataccgtctcatgcacaatgagat

SEQ ID NO: 340034 - DNA, 426 bp, Homo sapiens
catttccaagacaaaggggattcaagaccctcaactaaaatatactgaaggtggtagcccccagcagtccagtggtgactatagggccacacctaggctggctgaggctggattcaaaccgccctcaggtttattacccacctaacttggaccagttgttgccacatccctgagaggcaggttccttggctatcaactccaacagtccaaaaaacactaaaattacccaacagtcagataaggatgcggagaaatgagaacctctgtgcactgttggtgagaatgtaaaacagcgtagccactatagaaaacggtttggcaattcctcaaaaaattaaatataggattaccctttgacgcagaaactccacttccgcagaaactccaaaagaactgaaagcaaggattcaaacagattattgtcca

SEQ ID NO: 340035 - DNA, 555 bp, Homo sapiens
caacatagggattgtttgcagcaaagtgctttcctagtgatgttgaaagcagacaatgtgttaccaggaaatgatctctcattagatctcctttagatccaatgaaaaacatggtgtgctagcagacatatcaaacattaaaggcacagctgagatctgccattgctgaactccccatatatcaatttgttcaaagatgcaggttaaagggtaatggagacaagcattctgggaaaggattgagcaagagcctctgctgtcagctggactcttgaacccttctgtttgcttctgagaagtctattagagctgcaggcacaactttctaacaaagaaagctgactctcgaagtggactgggcttcctcacacagaaacgaacattttaccttaacatagcttagcagctaagaggatgatctttggagtcagagtgcctgaatttgtagccctgctccaccattcattagttccgtgaacttaagacctctctgtgcctcactttccttactgtaaaatgcgcccaataatagcaccttctttatagagtgtgaga

SEQ ID NO: 340036 - DNA, 188 bp, Homo sapiens
agagactggggagggggctagatagagttaggctgcagagtgtaagagccctacaggagggctccttgcactggaatagaactggctactggctctggagcctcctaggtgactgctgcgtggagaaggaggggcgggtccagccatcagactgggactccccagaccctgggcacaagtgactggag

SEQ ID NO: 340037 - DNA, 588 bp, Homo sapiens
tttttctttttttttttttctgaggagtttcactgttgctgcccaggctgcagcgcagtgctgggatctcggttcactgcatcctccaccccgccagttcaagtgattctcctgccttagcctcctgagtagctgggattacaggcacccacccaccaccatacccggccaattttttgtgttcttagtacacatggggtttcaccatgttggccaggatggtctcgaacttcagacctcaggtgatccgcccaccttggcctcccaaagtgctgggattacaggcatgagccaccgcacccagccagttaatttttctattaactaagacctaattaagattgaggcagaagaaatgggtccttgggatttgaaaattactattcaatttggaagtttaatttgcaacatagattgtctgttattaaattactagatataatatcacaaaggtggaaagaaaggttgcttagttaaagatctaagttactagtcatggtgtcagatatagagaatgattgaaggttatcagagtcacacaccagatgagtaaattgttgttttcaaggaagaggttacataaaggta

SEQ ID NO: 340038 - DNA, 532 bp, Homo sapiens
aatacagtattttgtgaatatataaagtagtactgaacaaacgccaagtcataaaagagtttgatatagtgtatgaatcaatgacccatcttttgcattttggctgtgatatttcagatgtcaccatctcaaccagcccctagtgaagagattatgcgccctttgaactcatctttgaggatcagcctaatatctgggtataggctaataccaagaagtcatttcaatacagttattgttaactgattttgtaaaatcaattgaagattaaggaactttgtgcctgacttttactatatcagtcaggacatacaatctgcctgtatgtcctgttagtcatataagtattagagtgcatagtttaatgtcttactagtgcacatcatccactgatattctaacagacctagtgctattatttcttgaaaacacataaataaattttgacaccgttgtcagaaccccaggaggttctccaaaaccaacagattagaattacattatccaaccactgtattaacaaaattatagg

SEQ ID NO: 340039 - DNA, 233 bp, Homo sapiens
gaaagggaagggaaggaaaagaagtagcatcagacatcaccaggtcccacagttaggacaatcaatcttggcacctgattttcccatccttacgcctgcattcctgtgagatgcccccatatccctctaataaatgcccttttttcataagttagtatgagcgggtttctagtcctataacaagacactccctgcccaaggacatccatcaaagcacactgccctttctgtgg

SEQ ID NO: 340040 - DNA, 146 bp, Homo sapiens
ttattttacagcattgcaatccccagggtgaaaacacaaataccaaaaatcaataaccaggaagaatacctcacatcttaatacaactcttttgatgtcaggaaaattttgatccaaccttagaaataaatctttaaatttgcatt

SEQ ID NO: 340041 - DNA, 506 bp, Homo sapiens
atcacttgaggccaggagttcaagaccagtgtgggtaatatagcaagattccatctctacaaaaatattttttttaaaaaatgtctcactcaaaatgggaacctgccctactagaagcacaccctgcgaacgggtgaaggcgcaaagatcagaaaattacagacggccaacatgacagcaaagcgttccacagaaaattacagcggccggcgaccgacacaacaacaaaacagcaaaggcttctgcagaaaatgacagcggccaacacggcagcaaaacagcaaaggcttcctttcttacgtttctgttgtgagcatgtttgtttaagggctgctaaccttcacctgccacccaaatgatgatgctgacgtcacagcccgtgggcccggatgtggcctgcggacatgtccatattcttggtaactctgttcccaatgtttggttttcagacaacagcccagtaaggctcccaggcaggccccaatgccgctggcctacagcacatg

SEQ ID NO: 340042 - DNA, 616 bp, Homo sapiens
tcggtacccgctgtggacgctgcctcccgccatcgagtcggtcttgctcctcgagggcgaggagatccccattcacaaggacaccaaggtacccaatgccagtttattcaccatcaacaaagaaggccacaccctggggtacatcatttaatcaagtgcactgcttccccttcgccttctgccgtgattgtcagtttcactgaggcactcccctgccctactagaagcacaccctgcgaacgggtgaaggcgcaaagatcagaaaattacagacggccaacatgacagcaaagcgttccacagaaaattacagcggccggcgaccgacacaacaacaaaacagcaaaggcttctgcagaaaatgacagcggccaacacggcagcaaaacagcaaaggcttcctttcttacgtttctgttgtgagcatgtttgtttaagggctgctaaccttcacctgccacccaaatgatgatgctgacgtcacagcccgtgggcccggatgtggcctgcggacatgtccatattcttggtaactctgttcccaatgtttggttttcagacaacagcccagtaaggctcccaggcaggccccaatgccgctggcctacagcacatg

SEQ ID NO: 340043 - DNA, 203 bp, Homo sapiens
gcatctagatgggaaaggaatgtcaatattagcagacaacatgaccgtccatgtggaaaatttgatggaatgtacagaaaactgactagaactaacaagtatgttgagtgaggttgcaggacacaaggtcaatacacaaataacagttgtatttctatataccagcaacaaactattggaaattaaaattttttttttttcgt

SEQ ID NO: 340044 - DNA, 205 bp, Homo sapiens
ctcctccatctctaaattttaaaaacaaatgtaccaatggaactatttcttcaatcttctccaaacacccgattgttgatataactttacctcaaagaatcatggtacagaagagctggaagggcctaaagttcagcaagctcttaaatgagacaaaaaggttccaagtcattttctctctcttttttttttgttttttgagatg

SEQ ID NO: 340045 - DNA, 271 bp, Homo sapiens
actccatgtggtcacacagtcacacacagtcacacagtcacacacagtcacacacggccacacagtcaaatgtggtcacacagtcacacgtggccacacagtcacacgcagtcacacacagtcacacagtcacatatggccacacagtcacacatggttacacagtcacacacactccacacggtcacacagtcacacacagtcacacagtcacacgtggccacacagtcacacctggtcacacagtcacatatggccacacagccacaca

SEQ ID NO: 340046 - DNA, 338 bp, Homo sapiens
ccaagggctaccaagggaaagagctttgggcagacggagcagcaaacacagaggcctggggtaggtagggacagcgaagaggcctgaccaggtaagcggcagggaggcggcatgatcaggaactgggttatggtaaggcttcctaccctcaaaaccacaggggggagggcaagggcgagaggccccgcagtttgtggtcatggcaatacaatgataataacactcctcattccttatttagatctgtaaacctttcctagtccagtctaatacataaaagaaagaaagaaatgtaaactatgtatttggtgggagcaagactaatctataacctttgg

SEQ ID NO: 340047 - DNA, 481 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggtaattccagccctggttttctgctgggaccagggtgccttctctgcccaggagggactgttccctgcctgctgcatctagtgtcacagtgggagggctcggaggactgtgcccaagtcacaattggggacactgaggcaaagaagattcatgcagtgaggctgggcagaaatgaggttggggtctcttgttcagcacagcttag

SEQ ID NO: 340048 - DNA, 2840 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttc

SEQ ID NO: 340049 - DNA, 3102 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctg

SEQ ID NO: 340050 - DNA, 667 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggtaagaggccaacccagttccctgtgcatgtggaggagaggagggtggggaggtcagtggaggctgagccttgaaggatgggaaaggaagaacattcctggtggaggagccctggggagcgggaacttaggacttgccgcaggaatgacgtctctgctcagtgaaggcagaagaccaggtgcgggacattcaaagccaggaggctgctgcgaggaggacatctgtgattccctggggggagagtggggct

SEQ ID NO: 340051 - DNA, 3178 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaag

SEQ ID NO: 340052 - DNA, 3640 bp, Homo sapiens
gcaggcagaagcagcaggtaccccctccacatccctagggctctgtgatgtaggcagaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttctttttttttttttcttttgagacagagtctcactctcgtcgcccaggctggaatgcagtggtgcgatctcggctctctgcagcctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggtttacaatttccatcagtctcccagccccgacctgccaaagtccccgggttttacaagccaggcttactgtgctgtgtctgcggtggaattctctcctctgtcccctcaagtctcctcatgggagtgacctgaaggtggtggcttcctccactttttctcagtataccttgcctttagtttcccacgaggagggaggctggactcttaactctgtacccttgatagtttttattctgg

SEQ ID NO: 340053 - DNA, 2830 bp, Homo sapiens
ccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttctttttttttttttcttttgagacagagtctcactctcgtcgcccaggctggaatgcagtggtgcgatctcggctctctgcagcctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggtttacaatttccatcagtctcccagccccgacctgccaaagtccccgggttttacaagccaggcttactgtgctgtgtctgcggtggaattctctcctctgtcccctcaagtctcctcatgggagtgacctgaaggtggtggcttcctccactttttctcagtataccttgcctttagtttcccacgaggagggaggctggactcttaactctgtacccttgatagtttttattctgg

SEQ ID NO: 340054 - DNA, 1663 bp, Homo sapiens
cggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatccaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaa

SEQ ID NO: 340055 - DNA, 585 bp, Homo sapiens
tgtataccaattctcaagcatgttgtcatgcattttttccttgtttgcctgattattttttgttgaatgccactcattgcacttgaaaacatgtagaaatcatttgaatcctaggaagatgatatctttctcagagaggatttatgtttgcttctgcccacagcctgggactctcacagtaccagataactttataccattttcagtacctgagaggatttgaagctgggccgaaatgcacatttggcctagttttcttgccatttacccttggtccttagatgcagcccaacccacagcacaaggagttgacaaacactcccccagaaatcagtacacacttcatggggctctggacttgacctgtcaccctagctttgcactaggtccaaagcactgctcagccttcgggagcttcttcagtggtcagcaactccccctgccacccagggaaaagtaggttaatcctttccagatgttggcccagtgattcttcactatcttgttagctcgctggctctttaatgctttaaagatgtgtgcgtgcgtgtgtgtgtgtgtgtgtgtgtgtgtgtgtgtgtgtgt

SEQ ID NO: 340056 - DNA, 172 bp, Homo sapiens
ggtgctaggggagcagagaagaggggcatgccatcggtgcacaaggaggtgtcactgacatgaatctgaaagggcgggtaggagttgccttagacaagttggtaagaagagaaatttgtggcaaccccagagaaggagggtacatgtagaaaggaagggtaaagagatgcaa

SEQ ID NO: 340057 - DNA, 503 bp, Homo sapiens
tcataatattctttgtaattataatgaagatgcacagaatactttaattctgctatatatttgagacaacaaagacttaaaaatgactataaatctgtgccaacagattcacaacacaaaatgatataatttgtgacatcaataaaacacatagggagccataaagaggcagggttttatatgtaatagtagttattcttggtaatatctatagtaacaacaaagaaaatacctacagttcttaggattttgagactagtctgggtaacatggaaaaaccctgtctctatgcaaaataacaactgttagccaggagtagtggtgcacatctgtggtcccaggtactcagaaggctgtggtgggaggattgtttgagttgagcctgagaggcagagcttgagtaagcagagattgtgccactgcactccagcctgggtgacagagcaagaccctgtcaaaaaaaaaaaggaaatacctatagtacacacacagaaagacataca

SEQ ID NO: 340058 - DNA, 1572 bp, Homo sapiens
gcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttccttccttccttcccttccctcccttccctcccttccctccct

SEQ ID NO: 340059 - DNA, 1652 bp, Homo sapiens
tatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttccttccttccttcccttccctcccttccctcccttccctccct

SEQ ID NO: 340060 - DNA, 1470 bp, Homo sapiens
gcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttccttccttccttcccttccctcccttccctcccttccctccct

SEQ ID NO: 340061 - DNA, 899 bp, Homo sapiens
ttagaggatccatggaccaggcagactcttctcccaggttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttccttccttccttcccttccctcccttccctcccttccctccct

SEQ ID NO: 340062 - DNA, 1073 bp, Homo sapiens
tcgaatcgtaaccgttcgtacgagaatcgctgtcctctccttgcggccgccagtgtggtggaattcccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttccttccttccttcccttccctcccttccctcccttccctccct

SEQ ID NO: 340063 - DNA, 354 bp, Homo sapiens
ccactgccatcagctaagacagggtactcaggcccagtagcccactgagggggctctgggcagccctgctcaggagactgggccagaggatggcagcacctctgtgcacctgtgaattacttaaacaactgtggtccattccatggactcaagtgtgctctaaagtctaatgttcacattttcagaaaagccctaagatcatctagttaccctctaaagcagctcgtgggactctccttcagcagtggcattgaaaggagattgcactgaaatgtgcaggaatggatttggcaagtatcatcttagcagatgaattaattcatttacaatatagtcactattgctggacactat

SEQ ID NO: 340064 - DNA, 681 bp, Homo sapiens
cgtcttatgatcatgaggagatgatgatgaggaatactctgtaaggtctagtgccctggaactagagctctgtcaagtcacctatgtctctgagatctccttgctctaaagttcttattaagtgagtagtgaataaccttaaggttcacactgccgatgagtggattttctgtcacttgcagccaaaagcatttctactgttaaactcactaaggttcagtagcactgttgtacctcttccctggccccttcatcatgcagactccttgttccagagcaacaaaatcttctgtctccatttttttgctcatttctctcaccatgaatgagttagacattttccaatattttatttgaaggtcatcattgatcactttgaaagtgtgcaacgacaaatagaataactaaatgaatgggttgctattgcaaaaattgcccagtacatcaacataacagaaacattctcaataaatcatcatagaagggaagtactaagaattttgcaatagtgcctagtgcaatagtgtagtgagatagtgtaaagttccccactcaaagtttcctttgcagaatgtgcattaataagcaaggaccagaattagatttaaaataatgatctcattaaacatttatagcccagcagtaaatttttgcaaacaaatgcaattttgcaaaccactc

SEQ ID NO: 340065 - DNA, 185 bp, Homo sapiens
tttcctttaaagaacttaacacctttgttggaattgtggccaaatccacacaccatacacacactcccagtgccctggcttttagctgctgcagatgtttgcagctggtagctgtgctgagcctccgcggaatttccaggcagtggagaggagttgttctcagggtcggctctgagcctcacgcc

SEQ ID NO: 340066 - DNA, 181 bp, Homo sapiens
catttgttgaaacgttaaacacagaaaaagcagcaagtattgagagagatgatgatgagttcagtttgggacaatttaaaaaattttgtagttggggcatcctgataggtgtctgtcagaaagtagaattgataggacacacgtgacagaaggatcggggcaagagaactgaagatttggg

SEQ ID NO: 340067 - DNA, 154 bp, Homo sapiens
atatagtaacattctcaggtcccagagagcatctttataccccttcctagtcacagtccccaaaagtaattgctgttctaccttccgttaccctagagctcacttcatataaattttgcctgaatttcatacacatgccgttttcttcgacgaa

SEQ ID NO: 340068 - DNA, 387 bp, Homo sapiens
agcatccagtctcagaatgtatattaagagggaagaaaacctatatgtcatagatccttgactcagtggatccagtcaccaaactccttcttagcctcaagaccctttgtgttaaacatctacacacacaatccttcccatccagatgatgccagcataagctgtcagggaaggctacacaaatacatttgatttctgaagatcctggaaaaggtaagaagtttatcattaaggaaatggaaagtcaaggcactcccacctgccttttactccacatatgcacgcatgaacagtgacagtgagatcatcttgggacctggaagctgtgtggccctgagcaaggaattcccatcactggttgcactttctggttgggttacaacatgt

SEQ ID NO: 340069 - DNA, 247 bp, Homo sapiens
tgtttagggggttttcctgttgtctttctgttatgatttctaatttgattctatataatcagagaagatactccctctgattttagtttttttaaatttgttgaggtttgttttatggcccaggtaatgttctatcttgctgaacgttccacaggcactcaaaaacaacatgtattctgttgttgggtctacctggaggtagacctaacccaaggttgaggcttactagaagtgtgaaaacgtaagc

SEQ ID NO: 340070 - DNA, 625 bp, Homo sapiens
gttctcaatactaagagattacttccaggtggcaacccaatgtagaaaaatcagcgtgtgctctggaatcagacaaacccagatctgaattctggtttttcttccctcttttgtgtcatcttaagcaagttacttagtttccgtgagcatcagtttcttcatctatgtactacaagtgatggatgcatacttctcaaatgtttagggagcttaaatggaaatatacttggagttcctagcacacagtaggtgcttactcgtgagcttgttccttctgcatttcccagctgtttctggaaagtgtgctgtcatcagcaagtgagtgaataatgataattgtatgctaatatttacccacacaaatacttcgcgcaaaactattcgtataatgttaatcagtgaaaaaggttctcatcatgtattatgagttgaattttctttcccgtctattaacaaactttgaatgggaaagctactgaattgaattttttttctctctctgtctctgctatactgtggggacatgcttttatatttgcaaataaagctcacatatatctttttattacattctcaccgtcccaccagaattttaatgagtaggagcggtgagtggagattgaga

SEQ ID NO: 340071 - DNA, 142 bp, Homo sapiens
cagtcattaacattttgtcatatttgctttatctccctccatacttttaagttaacattaaaattttgaaaaatattttgaacatagtgtgatcatggtggctcatgcctataatcccagtgctttgagaggctcaggcaga

SEQ ID NO: 340072 - DNA, 866 bp, Homo sapiens
tctcaatctcctgacctcgtgatctgcccacctcagcctcccaaaatgctgacattacaaccgtgagccattgcctattttttaattttctaaaaactggaaacaggttctcactatgctgtttcccagtctggtcttgaacttttgggctcaaggaatcccccctgactcctcagcttctgtaagtgctgagattacaggcttgagtcactgggcccagcctagacttttagtccaaagaagataatagggggagggatatgtctgtaggtgaatgagtggatctttcccttctctatcctggcattttctctccttcatctcatcgattaaaattctggtctgtgtatgtgttttgtttttgagttattttgtgttggttcatttgtttctgtttcttttttgtcagtacccctattgaaacacaaattctcttttctctgtcctgtgtgcccaccatattgcctggtaggatgacgtgttagagatgcccacacagacctggggagagattgggctgtgttctttctaacaccgccacagcactgataataacatgcagtcacaaccactccatttacaaagacaaagaggggtgttttctgcctccagacagttttagtaatgtatgctcctaaaatttttctttatctagggcaacactgtccagtagaagtccaacgcaaatcccatctgttattttaaattttctagtgtagtcatgtgttaaaatataaaacaaacaggtggagaaaattttcataatgtagtttatttcagtaattcagtacatccacaatattttcatttcaacatacgattcatacaaaaattgagatattttacatgaatttttcctgctcagt

SEQ ID NO: 340073 - DNA, 918 bp, Homo sapiens
ttcatgtatttccatagttaacagtggaggtctgcacactctgttgtcctggactcaaccttcagccaggtctggtacccacagaggccccctgtgtcttgccactcgaagcacggatgtgctaagtcagccctgagtctaaaccccactctctttgtgttgagttccttgactgtgctcactttggtatccagcttttgttaataactgggtattagttcccatttgtttggcagccttggtggaatcatacctttctttgtcagtccttttcgctcacgtacctgtgagcttgtggttctcactgacaggcacccacttggacaaactcagctatgggtaaccaataaaaccagatgaggttctccttctgtctggattttgtgtcttgagagcttgactttgatccatctggattttgtgtcttgagagcttgactttgatccagagacagcattctctctggctttctgcctgctgggtggcattttttgattggtacacctccagataaaattctgacgtacaaagtgcttcactaaaagattcattgactagagctaatgagcaattcgacaattgtaagaaagaacacactagactcatttttctggaaaacctccccctcatgtcccttggttgtctcctaatatccagctctcttttccttttatgctctgatcactgtccttccacacccacaccgcctccctcatcttcccttggtccagacctcctacttttcccaaacaaccctcctaaaactcctctttcaaaccagttatgtggggaaactgtagacttaagccttgggcctgggctgaattaagaggtataattaaagatttccctaatgcttgtaatctcagcacttagggaggttgaggcaggaggattgcttaagcccgggcgtctgag

SEQ ID NO: 340074 - DNA, 299 bp, Homo sapiens
ttgactggcttcatttctggaagattttagggggccaaggctcacctcaggattcctgggctgcatgctctaactctggggaagcagggtcaagaaaggacgctgtgttctctggtccctcaaggttagaaacatgccgaactggaggggcggatgtgttcctgttacgctgcccacagttttcaaatagggggtggtagccatactatttcattgggttggtggcagtgggatccaggctcacttgctcgtgccagtagcctcaacagcatggaagagtgtacatgtgtcagatgggg

SEQ ID NO: 340075 - DNA, 459 bp, Homo sapiens
tagtactctgaggatcccaagaggctgaatggccattgctatccgctaaaaccatcaggagaacctgacaaagaacttcataacaacacccgaatccagtggtccacagaacagcacagaagcaagcagatgtttgcagcctatgcacacagacatacgcaccaactacccagaaagttttcttgccataaaaattgaacccatcagcctctgtgaggctgaagggtagggtctgaggctatatggatgtgatgaggaaggcagagaccagagaaacggaatacacgtcctcagggatcagagacaaattgagaaacacaaatccatggtgagaggtcagcggagtcagagacccgcatgcagatagagggaggctggtggagaaacacagacacaacgaaacacataacgagagagactagcaaagaggggatcagaaactcacaaagggaagtcaat

SEQ ID NO: 340076 - DNA, 225 bp, Homo sapiens
agatctttgcatggatgtgttcttcatttatcatggtacattcctaggagtggaattgctgtgtcatatgagaagaatatatccaggctgatccatcaatcccagaaggagaacaagaaacacatggagcagagctaagttacccagcctagctcagcctagatcagcatcctgtaacaggcccccagccttgtgggctaaataaacatgtgttgttgtatgtta

SEQ ID NO: 340077 - DNA, 251 bp, Homo sapiens
agatctttgcatggatgtgttcttcatttatcatggtacattcctaggagtggaattgctgtgtcattacctgctcctgctttgccttccaccataaataaaagctccctgaggccaccccggaagtggaaggatgatggtgccatgcttgtattccctgcagaaccgatgatgaagaagtatctactctggaattacttcgtacaaaaaaagaaggtggagaactgtcagagaaatcaaaacaaagacct

SEQ ID NO: 340078 - DNA, 350 bp, Homo sapiens
gaatgaatgagggtagcaccttgggagctgtaattagggtagaatttccattcttctttcatttagccttggaaggggtcccgcaaaggcaggatttcggaagtgatttggttcaaccctcagttggctccctgtttcctactgcatcaaattcagatgtttcattctgatcacctgttatctcactaaccttagctgccacagctctttgtcatggagcctttggttagattctcatctgtgaagtatgttttttgcttttttttttttgctttgtggcacaggactggcaggtggatcgagtgtgggggagtatataaaaatattttgtacacttcagagacctaccc

SEQ ID NO: 340079 - DNA, 164 bp, Homo sapiens
ctcatcccacatgcctgggttctggagtcaacactgggctagtgatggggaaattgttttcaccaggaaatcaggatgagcagctgaagtcttcgaggaaacgcagtgaaaacaggaagcagcttctgtcagaggccagctcctggccgaggagccagggtgga

SEQ ID NO: 340080 - DNA, 532 bp, Homo sapiens
ctatttttgtacagacaaagctaagaaaggcttttacagtttttgagagattgattagggaaaaaaactaaaacccaatccacaaacaacaataatcagttgagaccacagtgtcctgcaaaacctgaaatatttactcactggcccgaggcaggggaagcttgtagacccctgggataaatgaatgaggcaggcaggagttggggtctgtggggagtttggccccagccaaaagagaaaccaaaaaatcctcaggccgaatagagcatacttctgaattgtgtgagccccttgtgccaattgtggcgcttactgtatgttaccacttactctgaaaagagttctgtgaggtcagagataccaaccccaatttactggtggaaaaacagaaatgaaagaacttgactggccaaagtgatgtggttggcaggcagcagagatggctttggcattctgggtgactggatgcccaccttaaatgcatatataagtggttcagtgacatttatctgttcatcacaaagacccaaag

SEQ ID NO: 340081 - DNA, 890 bp, Homo sapiens
tggaatgggaaaatgtagtcctgctttgtgctcagaaggaaaatgaagcagatgagcatgtaacagcatctctgccacaatagtattttccccattttacagatgatacagagaggtcctttctgaacaaaaggcataaaactacttggtagagatcatagaacctaggttaccttagatctgcgtattatgtgctcacgcgtctaaggacacattgaagtaattgaaaggtatttagattgtacatctagtagcattgctttctttcacattgggcattaaatgtcttcatctcttcatgtctgttattaatagactttaaatagattattaattgacttacctcataaggaataatcaactttaaaattttttcagtggtaattgccattttaagtaaagatgacacaatagcattataatatctttatggacatatttatggtcacctgtcttttgaatatacaatattgattaacctttgtttgtatgatttttgttttcaatacatgtgatgggttactgtgggccggccatctatccacataatgtttattcttgtgtgatgaatcggagactttgtttagccatgaaagttgttttttaaccttcccaaaaacttaactcttgtggaaagagttgcaccttcaactggaatacttctaatggaatagaattattttctaactgaggttataattggtacagctgtgaatgctgtactaataatgtaaatagcgagagtaggaatgatttacagaaactgttaacttttactggcaagttaaatctgacatctcagcattaacagttaacctttcattgtactttagactccttggagaatgtgttgaaagctgtggatctatcctgtgcctagaatatatata

SEQ ID NO: 340082 - DNA, 541 bp, Homo sapiens
tggaatgggaaaatgtagtcctgctttgtgctcagaaggaaaatgaagcagatgagcatgtaacagcatctctgccacaatagtattttccccattttacagatgatacagagaggtcctttctgaacaaaaggcataaaactacttggtagagatcatagaacctaggttaccttagatctgcgtattatgtgctcacgcgtctaaggacacattgaagtaattgaaaggtatttagattgtacatctagtagcattgctttctttcacattgggcattaaatgtcttcatctcttcatgtctgttattaatagactttaaatagattattaattgacttacctcataaggaataatcaactttaaaattttttcagtggtaattgccattttaagtaaagatgacacaatagcacgtgatccacgtgccattgtgtgtgtgtgtgtgtgtgtgtgtgtgtgtgtctttaaacggagtctagctctgctgcccaggctggagtgcagtggcacgatcttggctcactgcaacctccgcct

SEQ ID NO: 340083 - DNA, 1011 bp, Homo sapiens
gttgtagtgagccaagatcgcgccactgcactccaacctggcgacagagcgggactccatctcaaagaaagaaaaaaaaagacatgtccctgccttccagaagcttacggtcaagtgaagaggatgagcgttaaataatcacccccctcgccaaaaaaccacaaacacaattacatctgtgaccagtggtatcgagaaagtccagggcacagtagaaggacagcaagatcgccgttctggagctctaacaccatctcttcaagcaaacctgggaggaggtggcggaagagttaatgagaccagcaggcaaagggagggatggggacagcagagggaacagtgagtacacaaggcctaaggaaggagggatgtgcccctgagggtggccagatggcagcctggggccctcacagcgacccagccacagggtttgttccagagctcaaatacctcagatctccaggacaaggatgacaaggccagctgggcagtgtcccaggcccttctcctcaggctttaggcttccccaggagacctccggcaccattcagccttgttgcattgtggcacttggaaacaaagacagcggtcttctttgcttgactgtcaatagaatattgggagagcacaggtctccctgggaccctgcctcgccgctgatggcctgcagccctagacaaattcctcaacctctctgagcctcagtttccccacgtgcaaaatgaggttcttggaaggctgaacaaaatcccacatgtagatgtccaggctgtattgctggagacgccttccatgaattactacgcagataccaccacccatacagagctgtgctgtgctcctccacatcacactgcaaaggaagaaggcagaataacaagatctcaaacagcaatgttccgcctaatgaagtacagactggagattgccagctgcacccaaatccactctctcccccattcttgaatacagactccactttcactcagggcaagtccatcaaccaagagg

SEQ ID NO: 340084 - DNA, 265 bp, Homo sapiens
agaccacctgagcaggcttagtgtgagcaacaaggctgtttattcactagggtacaagtgggctgagtttgagaaaggagtcagtgaagatggtgggattatcattggtcttataggtttgggataggcggtggagttaggagcgactttttttgtgggcaggggatggatgttatgaagtacattctcaagagtggggaggatgttacaaagtacattcacaagggcggggaggatgtcttgtcccaaaggcagggaggaatgt

SEQ ID NO: 340085 - DNA, 600 bp, Homo sapiens
actacaagtgtgtgcactctagtcaggttattctgcagcattactgaaacccattccaagggctcctgtcttactttaggacttaatcatgccccagccaggtacttccacagcctctagcagttcatcctccacccactccatacttccgcaccattgcagagtgtttctaaatatgtctagtcatgccactctctgactttaaaacagaatcaagtggaacccccaaccatggctcataaagcccttctctgcctcacctcaatctactttcacagactcgcctttgcagccaacccacccttgtcactgtgactgtccactttatattcctggttctccaagttcatgatgtcctaacacgccaggctcctttctggcctttatgactctggagatgctaattctagtagctaaaattttctcttttctgaacaatacttctgcctctcaccattttctccatcatcttcttaacaattttacaaactcttgttcaacctttcagattgggttttatcacccaataagaaagtttcactgccccccttccccaattaagaaataatctctcttcggaagtatgtagtcgggtaccga

SEQ ID NO: 340086 - DNA, 155 bp, Homo sapiens
tttttagccttgaggttaccctttttcaccttgccaccagcatcagccttcttggcttcaggtttcttctctttagtatctggcttctcaactttttcacccgccatcttgcaagatgggaaagagctcactatgctatacttctaagctgagga

SEQ ID NO: 340087 - DNA, 314 bp, Homo sapiens
caaattaaagaataaatatactaagataaaagtttccccattatattacagagaaaaccatgttctgagctatggacttttatacctggatgtctaatctgaggccatcaaaagaactcactcatagatcagtttgcctcatttcatggtctgccttggattcccccacacccactgatccaaagtctgtggaatagggaggcaccttccagcaaagaaggcagacatgaaagtgtacattgtgatctctctgttacgaagttgaagaactggccaaactgatgtatgttaataggaatcaaaacaggggctgc

SEQ ID NO: 340088 - DNA, 253 bp, Homo sapiens
tctatcaaattatatgctatctacaggcagaatcttgctctgtcgcccaggccagagtgcagtgtggcatactcacagcttgcaatatcctgaattcctaggctcaagcaatccttccatgtcagcttctaagtattatagctaggactacgggtgcactaccacatgtggctaacttctactttttgtagaggtgaggtctcactatatgcctaggctggtctcaaactcctggcctcaagtgatccttcca

SEQ ID NO: 340089 - DNA, 386 bp, Homo sapiens
tgaaagcttgttaccgtaatgaatggactcacacatatcactgctttgcagtgatagcatcagccaaaagggctgcagaacatgaatcgttaacaagttgaaatatgtcaaagatggctgtgtggtgtgaagaagctgcattagctgcacaggctaagcctaaatgatattccaaatggcagagtgttcacctgaataccatcactgtaatcagtaacaataaaagatagggaaaactgaattattttttaggttgaaatgattttagcatggcagtttgttctcttgccactgtacattgaatcatatacttgatatttattgtgtgcctgtgatgtgccagtaacagtactctaaactaggagtccccagactacagcctgtgg

SEQ ID NO: 340090 - DNA, 238 bp, Homo sapiens
aaacaaaaaacaaaaaacaaaaaaacatggtggactttctgaatctttgtcctgaggttgccacaaactggtggtgtgtgggagccagcttggcttctattgactctgagcctgctgcacgtgtctatccaacttcacattcagtaatgtcatgctggcagcttgaaattcaccatggtgggagcatttacaccataggaattggcaaacagtggagatcagggttttttttcttcat

SEQ ID NO: 340091 - DNA, 578 bp, Homo sapiens
tgagaccctgtctttacagaattttttttttaaatttgcagggtgtggcagtacacacctatagtcccagctactcagctactcaggaggctaaggtgggaagatcacttgagcccagggggtcacggctgcagtgagcaaggatcacaccactgccctccagcctggtgacaacaagcaaccctgtctctaaaaaaaataattttatacaaaccacacacactctcataagcattgactagatcaggaatttttgttaaaaatttaaaaattatatacacacacacacacacacacacacacacacacacacatatatatacacacacacatacattcttccaaaaacaaaccaacaatttgccttgagacttcacatttggaactgataataaacattgacgggttcgtttaagatgctgtgagatgaaaacgccaaagccagaggatgtgatcctctcagagaaaaggctaaataatattaaaaatattttgtagtcttttaatatttcctaaattccagagcagtcatgcagaaatgaacatctaacacaatacactaggtacaggtacacaga

SEQ ID NO: 340092 - DNA, 537 bp, Homo sapiens
ccacagcatgaagaaacctggatgcctgaagcacagctttcctgctgaactgtgataacagtacctatgtgagaatagaccttgattgttctgagtcatggggacctggaatatgctgcagttagcctaccctaatgcaaatgtcaaagtaatcagcttcagttataaatgatctagatctgctagctacatctaatattaaatactaacatcaagctatgaatattctacataagcagcatttaccttatttccatttgcctcaaagtatgtgtagtgaaaacaaatagcaagagttatttttagtgctctacatcacaccaaaaacacagagagagttgatctagtggagtgaagagcttctgcctgtttgcatgctaattcctccttcaggcctcccctcacactggcgtcagtctttcctttaggatattttactcttgtacgtatcccttatatatccccgatttcagagcaagtgtccctgggtaacctctaaaatgtggtggctgggatagcaaggatgaacactcgctg

SEQ ID NO: 340093 - DNA, 332 bp, Homo sapiens
tgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattc

SEQ ID NO: 340094 - DNA, 1053 bp, Homo sapiens
tgtgtgctgttccgggatgatactgggggtctgtggtgcctgcgtgtgctggggtgtggaggttgtagtgtgtgtgtgttgctggagtgagctgtttgtgtgtttatgtgtgtgtcttgcccgagcgtgcgatatgtgtgcttgtgtcttgcctgtgtgtttctgtcttggctgaggccgtctctgtatctccggggcatgtgtcttttgcccagcgtttgtgatgctgcgcctgctaaatgcaaatgtctgttttctgtccaggtgtctgtgtgagttgtcaggtgtgagtgtgtgtgtgtatgtatgtgtgtggtggggggttgtttcagtctgggtttggcttgtgtgtctggcatcagcgtctgggatttgaggacccaggatctgtggggtctatgcagtgtagacggtgggtgttgctggcagcctctggatggggttgtgtctgagcctgtgtgtgtgtgtgtgtgttgggtctgaggggcttgtcactgtgatcggctggctcatgtgtgtcatgtgggctgcgtgtgtgtagtgtttatgtcagtcacgtgagaccagtgttttctgtgggtgcgctaggtgtgtgtgctgctgggctgtgtgggattagagttagctgtagggtgtgtgtgtgtgtgtgttgctgacagttggtgatgatgtttgagggttgcgtgaggagggtgggttggtgtctggtggtgtgttgaggtctgatggcatgtgtctgtgtgtgcctgatctacgtgtgtcctgagagttggtgacatgtgggtgtgttttgggggtgttgatgtatgtgtgtccgtgggtgtctgttttgtgttgatatgtgagtccagaggtgtgcaggtcttatctctggagtgagtgtgtgtgtgtggagaggggcatgtttgggaactgaggcagtgcctagcttgtgtgtgtgtgtttgtgtttgcaaaggctgcattgtgtttgcatgtgcccctgggcatatcaacagtgggtcagtgtgtgagactttgacagtttggatgtgtggggatggattgtgccagc

SEQ ID NO: 340095 - DNA, 1115 bp, Homo sapiens
gaggtgggggctgagatttctttgtactgaatcttccgtggtggatggctctgacctgagacctcaggtagcagaccacagccacatggtatgtctgcccagcgagcaggcctccaatgacgcggtccgtgaccgtgaggttctgcttcagaaccagggactgatcatgggctgaggtgacggtgaggtcataaaaataaggaccggggggctcaggcctctcccagtggggtttggcgccgtctctgtatctccggggcatgtgtcttttgcccagcgtttgtgatgctgcgcctgctaaatgcaaatgtctgttttctgtccaggtgtctgtgtgagttgtcaggtgtgagtgtgtgtgtgtatgtatgtgtgtggtggggggttgtttcagtctgggtttggcttgtgtgtctggcatcagcgtctgggatttgaggacccaggatctgtggggtctatgcagtgtagacggtgggtgttgctggcagcctctggatggggttgtgtctgagcctgtgtgtgtgtgtgtgtgttgggtctgaggggcttgtcactgtgatcggctggctcatgtgtgtcatgtgggctgcgtgtgtgtagtgtttatgtcagtcacgtgagaccagtgttttctgtgggtgcgctaggtgtgtgtgctgctgggctgtgtgggattagagttagctgtagggtgtgtgtgtgtgtgtgttgctgacagttggtgatgatgtttgagggttgcgtgaggagggtgggttggtgtctggtggtgtgttgaggtctgatggcatgtgtctgtgtgtgcctgatctacgtgtgtcctgagagttggtgacatgtgggtgtgttttgggggtgttgatgtatgtgtgtccgtgggtgtctgttttgtgttgatatgtgagtccagaggtgtgcaggtcttatctctggagtgagtgtgtgtgtgtggagaggggcatgtttgggaactgaggcagtgcctagcttgtgtgtgtgtgtttgtgtttgcaaaggctgcattgtgtttgcatgtgcccctgggcatatcaacagtgggtcagtgtgtgagactttgacagtttggatgtgtggggatggattgtgccagc

SEQ ID NO: 340096 - DNA, 1010 bp, Homo sapiens
gaggtgggggctgagatttctttgtactgaatcttccgtggtggatggctctgacctgagacctcaggtagcagaccacagccacatggtatgtctgcccagcgagcaggcctccaatgacgcggtccgtgaccgtgaggttctgcttcagaaccagggactgatcatgggctgaggtgacggtgaggtcataaaaataaggaccggggggctcaggcctctcccagtggggtttggcgccgtctctgtatctccggggcatgtgtcttttgcccagcgtttgtgatgctgcgcctgctaaatgcaaatgtctgttttctgtccaggtgtctgtgtgagttgtcaggtgtgagtgtgtgtgtgtatgtatgtgtgtggtggggggttgtttcagtctgggtttggcttgtgtgtctggcatcagcgtctgggatttgaggacccaggatctgtggggtctatgcagtgtagacggtgggtgttgctggcagcctctggatggggttgtgtctgagcctgtgtgtgtgtgtgtgtgttgggtctgaggggcttgtcactgtgatcggctggctcatgtgtgtcatgtggggtgtgtgtgtgtgtgtgttgctgacagttggtgatgatgtttgagggttgcgtgaggagggtgggttggtgtctggtggtgtgttgaggtctgatggcatgtgtctgtgtgtgcctgatctacgtgtgtcctgagagttggtgacatgtgggtgtgttttgggggtgttgatgtatgtgtgtccgtgggtgtctgttttgtgttgatatgtgagtccagaggtgtgcaggtcttatctctggagtgagtgtgtgtgtgtggagaggggcatgtttgggaactgaggcagtgcctagcttgtgtgtgtgtgtttgtgtttgcaaaggctgcattgtgtttgcatgtgcccctgggcatatcaacagtgggtcagtgtgtgagactttgacagtttggatgtgtggggatggattgtgccagc

SEQ ID NO: 340097 - DNA, 337 bp, Homo sapiens
tgcctgggtcattcatcagttacatacatcttcaactttaatagctattgccatattgttctccaaagtggttgtaactatttacactaccaccagcagtgtagaaaatgtctctcgttctacattctagccaaaattggaactgtcagacttggtgattttttgcaaatttgataggcatgaaatgttaacttggtggtattaacttgtattttccagattactagtaagaatgataatctttttatgtttattagtcattcatgtttcttcttctacgaactgcttattcaaatcatttttataatgggtgtcttttataaaaaatggtttgaga

SEQ ID NO: 340098 - DNA, 323 bp, Homo sapiens
tggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagtgtaaggcataaa

SEQ ID NO: 340099 - DNA, 128 bp, Homo sapiens
atacattagaaaatcaaaccatgaaataccatttgacactcattagaagggctaatttgaaaggtcaaatgttgatgaggctgtaaaacaactggaactccagtatgttgctgatgggagtgtaaaat

SEQ ID NO: 340100 - DNA, 174 bp, Homo sapiens
aatcttttacctcccaccatgaagaagaaatcctaacacctgataggtagatctggaggcaacatatttcatagctaggaatactgctccaaccccatatgccaatgccatgaaaggctgccaaggcccagagcaagaaaggattctgcaaaagtgtcaggctgctagagccat

SEQ ID NO: 340101 - DNA, 128 bp, Homo sapiens
taagagaaagacctctcccagaaagtgcgacgtatgctggagtcttcagtggcaaggagaggctttgcaaagcacagagggcagagcagagagacggctctaaaagtgcacaggcttggcagattccc

SEQ ID NO: 340102 - DNA, 565 bp, Homo sapiens
agtctatggatgatcacacatctaactgtgcttactggtaggactgcacacttcttatattttagcatgttttctctctgcgggttcactgcactttttggacataaaaccacaaagaatatgctactccacaaaatgttcactcacatgtttatgtatcgcgttagtgacaatggtaatgatcccttgcataaattactttcatctggcttcctagagctaattagtaccatgaccagtcagttaatggaataaatattaactcaggtttctatatgactttaattcatttatttattctatagatatttactagatatctattgtaggttggttctgtagcattctataggataaaatgttggatgagatcaagtcatcatcctcaagaagcttacatttaaaagagcttcgcacctaataaagccgtttacagggatacttttctctctgctatggttaagacctgctggagttgttaggcagccctggacgtggcctgtgtagaggacgcgtggtgttctccagtctggggggtttatcaccttctcaagaagtctgggca

SEQ ID NO: 340103 - DNA, 741 bp, Homo sapiens
agccaccatggcaattccttaaaaagttaaactaaggtttcccatgtgactcagcagttccacctgttgtgtatgcccaaaagaattgaaaacagatactcaaatacatgtatatgcatattcatagcagctctattcataaaagccaaaaggtggaatttaacagctctattcataaaagccaaaaggtggaaacaatttagatttccatcaggagatgattggatagacaaattatggtgtacgcatacagtggagtattattcagtcataaaaacggtatactaatatgtgctgcataatacggacggaccttaaacatactaagtgaaagaagccagacacaaaagctaacatgttgtttgcttctatttcatgaagtatccaaaataggtaaatccactgagacagaatacagatgagtggtttccagggactggaggggaggggagaatgggaagctgctgaatggatatggggtcgttttgaggtgatgaaaacatgttgcaaatatttagaggtggaggttacacaacattatgaattgttcactttattttttctttttttttgttcgctttaaagtggtcagtttactgtgaattttacctcaaaaaataaaaatgaacagaacttagtgtaggttaaaagcatgcatggtatgaatcagacatggtactgaatactggttctgccatctgttaatcctgcaactttaagtaaattaccttgaactccctg

SEQ ID NO: 340104 - DNA, 484 bp, Homo sapiens
catcaggctggaaccccagtgctgattcctgtccccgatgcctcactcaagcacacgtggggctccttggtgctctgccgctcactcagagctttgaaacatcagagggagcatcttcccttccctgtttcacctttgtggttcctgggcctgtggctgtgacctcccttgcctgggtggagccttggagtttaattctcttacccatgagggagttggggccataagcagagccatgccatgttccactcagcccctctcacaggtccaccctgttccctgctcagaaccagctattttcatcacagagtaaccagtctaagggacaggcctagatagaggatttgctgtgtagaattagtcccagagacactttttttgctaaccaaatcaaaatatcaccacgacttgccctatacaagcaattctttcttgtaaggagatttgatcaatgacattggcctgtgtaatactgttaggtaat

SEQ ID NO: 340105 - DNA, 272 bp, Homo sapiens
ggttaaaaaaaaattgacagcatttataccaccttcttcacttccactcttcttcctttttaaaccattgctagtcattttagaacatatgaaattcagtttattccgggcagaagcaggttcctgcttctgccccaggggctctgtgcctcttcttacaccctaccgagaggggctggtaacaaggttattttctgttcttccatcttcactcacgctctccagagcatgtctgctgcttcctgcttctgcccttgctggggctggtggtc

SEQ ID NO: 340106 - DNA, 180 bp, Homo sapiens
  misc_feature (8)..(8): n is a, c, g, or t
taccttcngcttctgcctgcttctgctgcttctgcttctgccccaggggctctgtgcctcttcttacaccctaccgagaggggctggtaacaaggttattttctgttcttccatcttcactcacgctctccagagcatgtctgctgcttcctgcttctgcccttgctggggctggtggtc

SEQ ID NO: 340107 - DNA, 375 bp, Homo sapiens
tccaacaatatgataggacttcttacacacatcacacatacgtgcactgcctgtgccacagtcagacacagttgctgctttctgatccatcagacaatgctgtagcacacacagcacattctaaccacatattcatatcagtgtctcagacacatgatgctactgagttcaagaaatttcaagtacattaacaacaaatatatattataggcatcttttgtaacagcaagagaaaggacctcataatctattaatacttttcatctactatcattacaatttgatagatactaaaaattgacttcagagttgctattcaaacataattcttaaaacatgctttcataagtcatgtagactaattcacaaagagac

SEQ ID NO: 340108 - DNA, 171 bp, Homo sapiens
tcatttgaggttttgcctcaaggtaaacctcactggcaaggtggctgtgataacagttagtttcttaaaggtaactggaacctaggccagaggagaggctgtggtaggaaagcactggagcgtctttctttctctacctgaaacagggccaactttccagaacagcatatg

SEQ ID NO: 340109 - DNA, 567 bp, Homo sapiens
ggccagcgacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagtgaaaggtcataggcattcgctgcagccatgcctgtagtacgtccatcaccaggcttcaatttatagcagctacatgactgcgtgtgtcaatctctaactggctcatgtgccagaccagaagctactattggaaaatgcccctctctcgtcatgtcgtttgcacagtaattcacttagatctgaactgagtacaaatgagtggtgctctaagatcaaagcaccagggtctttaaaatgatcttcactctccccgcaacctgccccgaacacgtgcatgctcctttcactttcaattccaaactgcacccttctaacgctggcctacagcacatg

SEQ ID NO: 340110 - DNA, 990 bp, Homo sapiens
catcaaaacagaacatttttaagcacaaattacacaggacctataaaacaaaaatacaagttaaaaagcaaaaacaaaaaacaaaaaaccaaagtactcagacaacaaagaacatgatgaatgtaaccatacctcacatttcaatactaacactgaatgtcaaaggcctaaatgctccacttaaaagatacagaactgcagaatgggtaagaactcaccaaccaatcatctgctgccttcagaagactcacctagcacataaggactcaaataaacttaaagtaaaggggtggaaaaaggcatttcatgcaaatggacaccaaaagtgagcaggggtagctatccttacatcagacaagcaaactttaaagcaacagcagttaaaagagacaaagaaggacattatacaatgctaaaggccttatccaacaggaaaatatcacaattctaaacatatatgtgcctaacactggagctcccaaatttacaaaacaattactaatagacctaagaaatgaggtggagagcaacacaataatagtgggggacttcaatactccactgacagcactagacagttcatcaagatagaaagtcaacaaagaaacaatggacttaaactataccttggaacaaatggacttaacagatgtatgcagaacatttcatccaataactgcagaagacacattctattcacagctcatggaattttctccaagatagaccatatgataggccataaagcgagcctcaataaatttaagaaaattgaaattatatcaagcactctctctggccacaatggaataaaactggaaatcaactccaaaagggaccttcaaaaccatgcaaatacaagaaaatttgaataacctgctcctgaatgagcattgggtcaaaaatgaaatcaagatggaaattttaaaattctttgaactgaatgaccataatgacacaacctatcaaaacctctgggatacagcaaag

SEQ ID NO: 340111 - DNA, 406 bp, Homo sapiens
acacaggaaaagaacttttgagcttccgggcacagcaaattgtgggaagataaatatattgggcaactagtggaagataagggctggctcataaggtttgttatatagattcccctcctgccatctgtgggctgataagagtctagagattgtattggctattaagaaatcatcctgcccttcttggtagagaaggggagggcagagttctttcatgtgtctgctttttctcaactgtcttcagctcaaaataatgcttatgctggggtggcaaatttgaggtaacacactctcaaccccttcacccatcaatctaaggtgaccaggaactaacttgtagtctaacaaagccaggttcactgacccatttcaatgagggagaatgcacaccagaaccatggggcat

SEQ ID NO: 340112 - DNA, 419 bp, Homo sapiens
tcgcttagtttagatatatcaaagaaacaaaagcatagaggcggctgggggtggtggctcacacctgtaatcccagcaactagtggaagataagggctggctcataaggtttgttatatagattcccctcctgccatctgtgggctgataagagtctagagattgtattggctattaagaaatcatcctgcccttcttggtagagaaggggagggcagagttctttcatgtgtctgctttttctcaactgtcttcagctcaaaataatgcttatgctggggtggcaaatttgaggtaacacactctcaaccccttcacccatcaatctaaggtgaccaggaactaacttgtagtctaacaaagccaggttcactgacccatttcaatgagggagaatgcacaccagaaccatggggcat

SEQ ID NO: 340113 - DNA, 535 bp, Homo sapiens
aaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcgtgcagttttgaactggaaaatgtgtgtggcatgatccaaagttcaggagataatgctgactggcaacgggtttcacaggttcccagggggccagagagtgatcactccaacatgggccagtgccaaggt

SEQ ID NO: 340114 - DNA, 326 bp, Homo sapiens
gctttaaattccaatttgatttcattcattttggatttttcttgggaaaaagaaatgtagcccttatgtacaatctttctgagccaaggttttctaatttatggaccagtattaattgaatttcgaactgtctttctgtttcatactgagatctgcaattcattttccaaagcagggtccttggttactaatccattgcaataattaagccccaccaatcttcttgccagtcgagctgtgagctgctcttgctttgtgctgtggatgtgaacagtactgcaccccaagccagctcacataaaggctgttgcatttcaccatccact

SEQ ID NO: 340115 - DNA, 336 bp, Homo sapiens
tgagactctgacttgctgaaggttaccagactaatagcaattccagtattaattgcttatcttgtcacttcagatcttttctcaacctcacgctattctctcaggactcttccttttaagattatgcaatttctattggatcaagaatttggagacattgttttttcttttcctgaacagaatgtgtttcagaaatcagaatattaaatttaaagcaattgtctaaaataatgtacatctaggtaatgctattactatcaatgataagagttcattttagtgcagataattattttttgatgaacaagatgtaaatatgcatggctaaaggggtag

SEQ ID NO: 340116 - DNA, 1981 bp, Homo sapiens
tctgtatgaattctcctatgttttgcatagaatgaagcttgactgagaccttgtcacaatcatgacatttgtaaggtttctctccagtacgagttcgccgatgaactgcaagttatgaacaatgtctgaaaattttgccaaatttattaaactagtatgatctctcttcattatggattctccaatgattcgcaatggttgtagtgtaactgaagactttgtgacaatcattacataagtaaagtttacagtcgcaaatcaagcctccaaagacaggagaattcatactggagagaaagcttacatatgtgaagaatgtcaccaagttttcagtcacactcaaaccttgaaagacacaggagaattcctactggagagatagcataaaaatgtaagagtttgtgacaaggctttcaggcataattcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaataaatttggcaaatttttcagacattgttcataacttgcagttcatcggcgaactcgtactggagagaaaccttacaaatgtcatgattgtgacaaggtctcagtcaagcttcattctatgcaaaacataggagaattcatacaggagagaaacctcacaagtgtgatgattgtggcaaagcctttaattcacattcacacctcactagacatcagagaatgcatactggacagaaatcttataaatgtcatcagtgtgccaaagtcttcagtctgagctcactccttgcaggatatcagaaaattcattttggagatagttgttccaaatacaatgtgtatagcaaaccatcaagcattaattgacactagagtcagttcagcattgacttgagtttgacttaacattgagttgaagccttaattgacattaaagtgtttatgttaagaggactggccaggcacagtggctcacacctgtaatctgagagctttgggaggccagcaccggtagatcacttgagttcaggagtttgaggtcagcctggccaacagacgtgagccattttcccagcctgttttttgtttctttaacaaaaactgatagggatttttttttttttttttgagatggagtttcactcttgttgcccaggctggactgcaatggagcgatcccagctcactacaacctccgcctcccaggttcaagcaattctcctgcctcagcctccagagtagctaggattacaggcatgagccaccacgcccagctaattttgtatttttagtagagatggggtttctccatgttggttaggctggtcttgaactcccagcctcagatgatccacccacctcggcctcccaaagtgctgggattacaggcgtgagccactgcgcccagccccagtgataaggatttttatgggtaccgtgttgaatctaaatcacattgggttatataatcatttaacaatattaatttttccaaaccataagtatgggttgtagctctatgtttctaatcattttgatcaatgtttgtagatttcaaggtaaaaacctctgacctttttacgtttatttctaagtatttcttactttaagttctccagccaatggaagtgttttaaaattttcttttaaagttgtttattgttaaaagtatggaaattcaactaatttttggtgctgatactgtattgtgcaaatccactgaatatgttacttagttccagtagtattttggttgactctttgtgattttctgcacagaagatcatgtcgtctacaaacaaatataattttacttctttctttctgatttcgat

SEQ ID NO: 340117 - DNA, 2110 bp, Homo sapiens
agcattttacaaatgtaatgattgtcaccaagtcttgagtaatgctacaactattgcaaatcattggagaatccataatgaagagagatcctacaagtgtgataaatgcagaataaatgcagaaaatttttcagacatccttcatacctttgcagttcatgggtgaagtcgtattagaaaccttacaaatgtgaagaatgtgatgaagctttcagattcaaatcaaaccttgatagtcatagaattcatactagagagaaaccttagcagtgtaatgaacgtggcaaggttttaaatcaaaaagcaaagcttgcacatcatcatagaattcatactggagataaacgttacaaatgtgaagcatgtgacaaagtttacagtcgcaaatcaagcctccaaagacaggagaattcatactggagagaaagcttacatatgtgaagaatgtcaccaagttttcagtcacactcaaaccttgaaagacacaggagaattcctactggagagatagcataaaaatgtaagagtttgtgacaaggctttcaggcataattcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaataaatttggcaaatttttcagacattgttcataacttgcagttcatcggcgaactcgtactggagagaaaccttacaaatgtcatgattgtgacaaggtctcagtcaagcttcattctatgcaaaacataggagaattcatacaggagagaaacctcacaagtgtgatgattgtggcaaagcctttaattcacattcacacctcactagacatcagagaatgcatactggacagaaatcttataaatgtcatcagtgtgccaaagtcttcagtctgagctcactccttgcaggatatcagaaaattcattttggagatagttgttccaaatacaatgtgtatagcaaaccatcaagcattaattgacactagagtcagttcagcattgacttgagtttgacttaacattgagttgaagccttaattgacattaaagtgtttatgttaagaggactggccaggcacagtggctcacacctgtaatctgagagctttgggaggccagcaccggtagatcacttgagttcaggagtttgaggtcagcctggccaacagacgtgagccattttcccagcctgttttttgtttctttaacaaaaactgatagggatttttttttttttttttgagatggagtttcactcttgttgcccaggctggactgcaatggagcgatcccagctcactacaacctccgcctcccaggttcaagcaattctcctgcctcagcctccagagtagctaggattacaggcatgagccaccacgcccagctaattttgtatttttagtagagatggggtttctccatgttggttaggctggtcttgaactcccagcctcagatgatccacccacctcggcctcccaaagtgctgggattacaggcgtgagccactgcgcccagccccagtgataaggatttttatgggtaccgtgttgaatctaaatcacattgggttatataatcatttaacaatattaatttttccaaaccataagtatgggttgtagctctatgtttctaatcattttgatcaatgtttgtagatttcaaggtaaaaacctctgacctttttacgtttatttctaagtatttcttactttaagttctccagccaatggaagtgttttaaaattttcttttaaagttgtttattgttaaaagtatggaaattcaactaatttttggtgctgatactgtattgtgcaaatccactgaatatgttacttagttccagtagtattttggttgactctttgtgattttctgcacagaagatcatgtcgtctacaaacaaatataattttacttctttctttctgatttcgat

SEQ ID NO: 340118 - DNA, 1624 bp, Homo sapiens
acgcgtagctatctctcatatggtcgactgcaggcggacgcgaatcactagtgattgtgagctgagatcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaataaatttggcaaatttttcagacattgttcataacttgcagttcatcggcgaactcgtactggagagaaaccttacaaatgtcatgattgtgacaaggtctcagtcaagcttcattctatgcaaaacataggagaattcatacaggagagaaacctcacaagtgtgatgattgtggcaaagcctttaattcacattcacacctcactagacatcagagaatgcatactggacagaaatcttataaatgtcatcagtgtgccaaagtcttcagtctgagctcactccttgcaggatatcagaaaattcattttggagatagttgttccaaatacaatgtgtatagcaaaccatcaagcattaattgacactagagtcagttcagcattgacttgagtttgacttaacattgagttgaagccttaattgacattaaagtgtttatgttaagaggactggccaggcacagtggctcacacctgtaatctgagagctttgggaggccagcaccggtagatcacttgagttcaggagtttgaggtcagcctggccaacagacgtgagccattttcccagcctgttttttgtttctttaacaaaaactgatagggatttttttttttttttttgagatggagtttcactcttgttgcccaggctggactgcaatggagcgatcccagctcactacaacctccgcctcccaggttcaagcaattctcctgcctcagcctccagagtagctaggattacaggcatgagccaccacgcccagctaattttgtatttttagtagagatggggtttctccatgttggttaggctggtcttgaactcccagcctcagatgatccacccacctcggcctcccaaagtgctgggattacaggcgtgagccactgcgcccagccccagtgataaggatttttatgggtaccgtgttgaatctaaatcacattgggttatataatcatttaacaatattaatttttccaaaccataagtatgggttgtagctctatgtttctaatcattttgatcaatgtttgtagatttcaaggtaaaaacctctgacctttttacgtttatttctaagtatttcttactttaagttctccagccaatggaagtgttttaaaattttcttttaaagttgtttattgttaaaagtatggaaattcaactaatttttggtgctgatactgtattgtgcaaatccactgaatatgttacttagttccagtagtattttggttgactctttgtgattttctgcacagaagatcatgtcgtctacaaacaaatataattttacttctttctttctgatttcgat

SEQ ID NO: 340119 - DNA, 526 bp, Homo sapiens
agcattttacaaatgtaatgattgtcaccaagtcttgagtaatgctacaactattgcaaatcattggagaatccataatgaagagagatcctacaagtgtgataaatgcagaataaatgcagaaaatttttcagacatccttcatacctttgcagttcatgggtgaagtcgtattagaaaccttacaaatgtgaagaatgtgatgaagctttcagattcaaatcaaaccttgatagtcatagaattcatactagagagaaaccttagcagtgtaatgaacgtggcaaggttttaaatcaaaaagcaaagcttgcacatcatcatagaattcatactggagataaacgttacaaatgtgaagcatgtgacaaagtttacagtcgcaaatcaagcctccaaagacaggagaattcatactggagagaaagcttacatatgtgaattatgcctgaaagccttgtcacaaactcttacatttttatgctatctctccagtaggaattctcctgtgtctttcaaggtttga

SEQ ID NO: 340120 - DNA, 556 bp, Homo sapiens
aggaaacagtgtgattggaggcgggggtggggaggttgtctgctggcttgtagccaaggtatgaacggctggggtagtgtcgtggatctccaacttgggcaggtgtcagaattgcgtggagggctttgaaaaaacaacattgggccccaacccacattttcagattcagaaggtcttgggtatcgtccaagaatttgaatttctaacaaatttccaggcaatgctgtttctgcggccccagggactctgctttgagaaccactggtctaatgtaatcccctcccagtggatattcatgaagcagaaacctccagggagtgggagctgggggctccaggacacgcagagccctgcctctggggtcattccgtgcacatctgttttacacagtgagcagccttggaaaactttcacttgaaaaaaatgtgggtagaaaaaaatgtttgaaaacctctgaagcaaaggcaagacttttaatcatgggaatggtgaatgttcattctttaattgaggggcaaagcaggcaggatccttggtccctcttgttgccagatgt

SEQ ID NO: 340121 - DNA, 294 bp, Homo sapiens
ccaatgctttccacgagtaatcagattcaggcccttgtgcctgaagactccttgtgaagactagatgacaccttctccaagagcagctaaggaatcaccttggctcctcaggctgagtatacatgttctgtatggaacttcagaaagaaatggtcaacattcattcctcactttaccagagaaagaagaaaatgtcacgtgcctttgattccctctttttaccaagactccactgagataaaactcctaacacagaaaccaacacatattctcaacactgggtacctgctggag

SEQ ID NO: 340122 - DNA, 248 bp, Homo sapiens
aggaaagaaccctagaactctctaatttcaatggaaacaatttaggaactcttctctgctgtgctatattacatttctttaaagttgttatcattttcatgtgagtttacatgttgtacatttcaatcaggggtatatcagctatttcttctggagccagctatggtgtccttggctcacaacaactcttcaatgcatgttcttgatggaatgaaaggcaattactgtgacgtaaagaggactatgaa

SEQ ID NO: 340123 - DNA, 377 bp, Homo sapiens
tgggaactataaaaaaatagacatactgaccaatgaaatagaatagagagcccagaaataaacgtacacacctacaaccgtctgatcttttacaaaattgacaggattttgcaatgaggaaagaacatcctattcaataaatgatgcagggatagctggctagctatatcaaaagaactggacccctacctctcaccacatataaaaatcaatgcaatagggattaaatacttaaatataagacctcaaactataaaaatcctagaagaaaagcttcttgatatttgctttggcaaataatttgtgaataagtccccaaaagtaattgtaacagaaacaaaagttgacaagtgggacctaataaaactaaagagctt

SEQ ID NO: 340124 - DNA, 353 bp, Homo sapiens
acggcagtgcaccgtgtatagggtgatggtcgttctagagtatccaccagcccaaagtgaaaaggcaatactccaacctccaaagcctcacaggtgatacacaagcattggatgcagttatgatcgatctctctccaatttcatcttgggtaaataagcgcattttattaaaaattttctggttatttctcaaatgggctattttataaaagagaaaaatgtcaaaattctgtatgttaaatcccattatatcaagcaagcaacatggctcattgtttttctttcatttatattttccatctcgataaacaaaaacaaaacaaaacaaaatacctgatttttcactttgggct

SEQ ID NO: 340125 - DNA, 175 bp, Homo sapiens
gctggcacacaaagatgctcaaaacatgtttgtgaaataaatctgagctattcttactttctactgctcacgtgtatctacgtaaattttcttaagtcttttaagtaagagtcatttctttaaaacatttcattgcttttctattttgtttgattcttttttttttttttttttt

SEQ ID NO: 340126 - DNA, 267 bp, Homo sapiens
tgtggtgaacgtgctctgatgcctggtgcttagaggcttagaatggggtcaggctctcctcccactcaaagaggtccctggtgagtggggtaaaccaggaagagaggagggctgctgcagctctcaaatacccaaggccacctctttgaggaggattcttagttcctggggaatgggggaggggctagttcccagctcaccccacagaatcactcctaccctccagctaagcatctgctttgcccctcttctccccatatgggtgca

SEQ ID NO: 340127 - DNA, 186 bp, Homo sapiens
tctgtcctccccttcaaagcccaaattctctaaatgattaagtacccatggtcatttcctcatgcccacaggctcctcaacccattaccattgggctcatgtgcctacctgctttctaaagctgccttcaccaatgttaccaggagcctcctcattgataaaactcattggatactttccattcct

SEQ ID NO: 340128 - DNA, 705 bp, Homo sapiens
gtttggatttatctctcaacaaacataaatgacattctagactattctcagaattggatagctcctttttattaatatgcctttaggagtcttcatctttaaagtcaacactcttcagctaatcacagatctaagcttacatgaaatctgaaaataaactttactgtgttttcagggtttggccttaaagtaacggtggatggcagatgtagttgtttgactgttgtgttaaacaaacaaacaaataaaagggaagaggaagagaatgaaagaccatttccttaccaagcaatcacacagtttattgtctaggaaataaaaaagaagaagaagaaagaaaggaaaagaaagaaaaaaagaaaagagccagttttgtgtactgttgagcacacagatgttcctcttggcagccatacagtactagtcaggattggggtttctgcagacgtagaatgtgaggcttctttgttggggacaaagtgttgcctgtggtgggaattgctgcagtgatgggaaagtatcgtaatgtattgttggattactgtgattttcaatagagacagtacattaaagtagctttgtgggcagtggattgtttcagccaagcctggctaataacacactcattttggcaaagtctatttaaaaggtagagctggcatagttttgtggtcatggagcctgtcccatacttgggcattagaa

SEQ ID NO: 340129 - DNA, 292 bp, Homo sapiens
tgggtctggggtgagttcctttcttctccagtggagttgttcttctctagagtctgctcgcttctcccagtgtaggatgagttcaaagctgttgcatatctccagtggagcacttcttttctttcttttactctatgtcacatttatttctgctctgatattttggctgtattttcattccccatggcctctaaagctgcttctgcaaaagggttgaatttactctgtatgggaagtcttgtactctttgggtaactttagtcgaacagtctcttgtacttttctagaccag

SEQ ID NO: 340130 - DNA, 504 bp, Homo sapiens
acttcagggcagtaggtgaagtgtgctgcttcttttcaggttcaggttcctatgaagtttaatatatatcattgaagaatttactagaccacattagtgcccctacttatcaagagagcctgcagaaacctgagccagtcatgaagcaggtgttacaagcatctgcactccatatttgctactgagatctctcatctcagccttattgagtattgattggtgataattcctaacaagtttggaaatatcatcacctagacccttgaagcaagagcaaaacagggtgggatgggagtagacttgtttgggtcatggaatcagtagctgttaaaatcaccccaatgttggggcacagtggctcacacctgcaatccccgccctatgggaggctgaggcaggctgatcacttgagctcaggaattcaagaccagcacagacaacatggagaaacctcatctctacaaaaaaaaaaatacaaaacttagccaggcgtggtggcatgtg

SEQ ID NO: 340131 - DNA, 268 bp, Homo sapiens
gtctctcctcatgctattcctcagctgtaagaccagttcttctcttccctaattcattgtccatatctccatcacaagtcaactctaaactcaacatttttgagttttccttaagccagttccctgactcttcagcacagcctctttcttatggactcaatttaaactacaataatgtgtgtttgttgacattttctatgttagagaagtttacctcagtattttacttcccatcaaaataataaatttctccactgttttttttttt

SEQ ID NO: 340132 - DNA, 675 bp, Homo sapiens
gcaaaagataatttgggctaaacaggatagatgaataaaccaaagggcaaattttagggctgatgaagacagaggtgcagtaagcgtttgctgtagttgtttgactaaattttgccatgaatactctctaacttacacacagtgggtatacaatacttgtcaagtgcctgaaaaggtacaattatcctaagatgaccatggaataagagtatcattcgtggtgcctagatttttcatgtgctcctcccacagaaaaagctacaatcattttcttattgatacgcaagttcatataggaacttagatgtgctccttcactacttttcacatatttgtcacatgtcagtatacttggaattatttgctcagtgttgattttcagattcaaagttttatgaagatgggggcatgttcgacttttttgtttatatagcacctgttaatcagcaatatctgctgtgaaatgaataaactgatgatttcaaaacccactcgactgcaggaactttgatctctaatagataaggatctatcattagttctttataagaagatgtgcgcttaagaaaagctttcttgaaactaatctcggtagtgtaaattaattccttttttttttttcgagacggagtctcgctctgtcgccctggctggagtgcagtggcgcgatctcgg

SEQ ID NO: 340133 - DNA, 362 bp, Homo sapiens
gtggaaaaatatagcacctacacctctcctactgaaagaaagccatgccactattttggtggggttccctctaaatcttttttcctctgcctgctggttgcattatagagtaaaccaagccaggggagagggttttccaaagtaagtgttagggtggtacccaggagggatggaggttccatgttgtgatgaactctatgccctggcagaggccacctccaggggttccttggtcctgccacctgcacccaggagatcctgagcccctctgacccgagcactcacacctgggtctctcatgcggcttctccacgcactggctcttgttcccattcacactgagatggcttttcaacgtaaaa

SEQ ID NO: 340134 - DNA, 147 bp, Homo sapiens
cggtcctcccttcaccagctccttccaccaggccagacattttgaagccacccattccacaaccactgcagcaaagaaccatgaaatgggtggcttcaaacaatgtctgggcctggtgctgtggctcacacctaaataatctcagca

SEQ ID NO: 340135 - DNA, 616 bp, Homo sapiens
atagaacaaaaatgtgtctctgccaagctggttctattccagcaggggaggaaggcagcgggccagatcagtgagtgcatgtctgatggtgactgctgagaaaatttaatcggaaatagggaattacgaagtgccggaccgtggaaggtgctgcagtttccagggaaggcctccccaaaagttgacatttgagtacagacttgagtggcagcaccagagcgagagccgtgtgtgccggtatctgggggaagagtgtcacaggcctagggaacagccagcacggaagcccgaggcaggtgcatgcctgtgtgccccaggattggcctctggttggctggggaggcctgctcctcaaagggctggtatatcacatccatcacaggctaagagtaaccgcctcgtggttcctcctcatagaggccaggtgcggtgtgtcatctgcttccagctctcagcatctctgctgggaggcaggattcctgttcccattttacagatgagaaaactgaggttaaaagaaggcaggtgatgtgtcccggggcatgtggctgggcaagcagtgccactgggctcctccacttccaggtccctgtgatgctgggaaactgagtcacgg

SEQ ID NO: 340136 - DNA, 189 bp, Homo sapiens
aaggtgctttgaacacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataatta

SEQ ID NO: 340137 - DNA, 184 bp, Homo sapiens
ctgctgggggttgacaaggcttcttgggtctgtggatttatagcatttgttacatttgggaatctctggccactcttttctcagatcccccgcctgccctcaggactccagttacttgcacgtgggatcccctgctgtcgtccgcaggtcaccgaggtggtgttcgtttcctgtaggcttctta

SEQ ID NO: 340138 - DNA, 166 bp, Homo sapiens
ggcacagatgccacataatgaccattgtttactgggtttggggacacactggtttttaatatttatttagttaaaatctatcaaaagtatttctttattgcttctgctctagtcatttccttattcttcttccttattcaaagcagttccaaccccacccatgcaa

SEQ ID NO: 340139 - DNA, 92 bp, Homo sapiens
tttgcatgctgctgcagcctttaaagtattgaagtaactggagaattgccaatacagccagagagaaagggactacagctttttagagaagt

SEQ ID NO: 340140 - DNA, 197 bp, Homo sapiens
gggatttggtttctgaagcttagaagacctgaaaaaggaaggattcagcaagtttatagagcagttggtgagggatagattatattcctattagtgtgtttagaatgttaaaatctagtgtaataacagaaatctcaagtgagaatgtctccaaaaggcatgtgctgggagtgttgttatgaaagtatctttgtttt

SEQ ID NO: 340141 - DNA, 159 bp, Homo sapiens
tactataaaatgcaaatattccaaaaaaaatctgaaatctgaaacatttctggtcctaagcaagcattttgcaaagggatacgcaacctgtagtacgttctttatcattgttttaagtagttaatatattgtggtacagattctgaggtggtatagcaa

SEQ ID NO: 340142 - DNA, 409 bp, Homo sapiens
agttagactttgaacttaaaaaggaaaatccatgagggttatcctgtgtccctactaccaaatatttctattccattctattctagacatcaaaaatgtgccaagtatccactaagctaagtgctggacacatggtgtctcaggaacaggcatagccttgctagtcatagtgagggtgtttcatttaactcatagaacaaagtgtcatctgataatttcttattttgcttacttttattgtctgcctctccccatgaaaatatattctcattaaagttggaaacttctttgtgctttcttcctgtgtacctctagcagttggactaaagcctggcaaatgttaagtgctcttaaactttttgttgaatgaatgtgtgactgaatgattgagttctcctttaaaaaaaaa

SEQ ID NO: 340143 - DNA, 478 bp, Homo sapiens
tgactcagaggatcccgagggtgaccttcgtgggaagaggaaaatgaatgatcgtgtgttctgttatcctgtgagaagagtgagcctttaaaaagtgaataaacaccattccagttgtcgcaaaatctctactaataataagcaaaatgccttaaaagcacagtatgctctcgatgacctatgttttggattattcctatttaatggaggtgggggtggggagttaaagagcaacacatgatcgggtgcagtggctaaggcctgtaatcccagcactttgggaggccgaggcgggcagatcgcctgaggtcaggagttcgagaccagcctggccaacatggtgaaacactgtctctactaaaaatacaaaaattagcggggcgtggtggcacacgtctgtagtcccagctatggaggctgaggcagaagaattatttgaacccgggatggggaggttgcagtgagctgagatcgtgcc

SEQ ID NO: 340144 - DNA, 502 bp, Homo sapiens
gcggtagtcacacacacactatgcttctcacgcccactgctgcaaacaccttcgtgggaagaggaaaatgaatgatcgtgtgttctgttatcctgtgagaagagtgagcctttaaaaagtgaataaacaccattccagttgtcgcaaaatctctactaataataagcaaaatgccttaaaagcacagtatgctctcgatgacctatgttttggattattcctatttaatggaggtgggggtggggagttaaagagcaacacatgatcgggtgcagtggctaaggcctgtaatcccagcactttgggaggccgaggcgggcagatcgcctgaggtcaggagttcgagaccagcctggccaacatggtgaaacactgtctctactaaaaatacaaaaattagcggggcgtggtggcacacgtctgtagtcccagctatggaggctgaggcagaagaattatttgaacccgggatggggaggttgcagtgagctgagatcgtgcc

SEQ ID NO: 340145 - DNA, 301 bp, Homo sapiens
atgtgaatttgaacagcaatgtttagcacgtaacttggaaacgttttaaatgaaaacagatggcaaaatgtctagcccacagtaaacactcagtatgtatttgttaactcaataaatgacaaaactgcattaaaattctctgtgttcagttcttcaaatattcatttagtatagtattaaactgcttgggcaaatgcaaaaatcaaaaaagatgtctagagtaagtatagaaatctaaccacagtataaagatcctgatgctctcagcacccaatttcctttggagaatctaccactacga

SEQ ID NO: 340146 - DNA, 754 bp, Homo sapiens
atcaaagttaaggaggaactagtcaaacattagtaaaatgcaaaaacattttaagttaattgttggaactggtggaagacttccttaaaggaacatttccttttaaattttttattttatattttagggggggctgcatacttctctatgtaattgttagatacaaaaggagaacccaatgtgtatgaagtaatttctttttatcattaatttttgtaccaatgaatttttaaattcctcataaaatattactctttcaaaaatattttatttaaaatctagcaaataaataaaatattgtattatataacaccttccactttttaaaagaatttgcatgtaacatttcactgatttgaattttgcaggaatgtaatatcttaacactctcctcctatccttttgccagaatttcagaatagttacagttgacctaaatttcattaaaaaaaaaaagtcaaacttgtgtgtgatttcaaagctgcaaaatgacagctttgattcctgtgtctcatccctatggcaaagcaaaattctatgtgtgacatcacaaactagccaatagcaactttatccccagagacaccatgcctgacttttcctattgctgaggtctgctagagcttaggcaagtgctgagcagccgacagccatgatgtgtgggaattcgcagaacttcccagagtccttgtattcctctatactgaacccatgagtgcttcgtgtcctctccgccacttacctctgtatatcc

SEQ ID NO: 340147 - DNA, 137 bp, Homo sapiens
tgtgttgttaggtgattttggggaagtgtcaaggttttgctctggattggatgctggcaggaaacaggtgatcctataacttaatattttaatatttgctatctagaaggcaggaagaatggatcaaggctaagcct

SEQ ID NO: 340148 - DNA, 318 bp, Homo sapiens
ctgccagtagtcctcccaatcgccacgacaaggagctgagaccactgacgcgcaccaccacgcccagctagttttttgtatttttttttgagatgaggttttgccatgttgcgcaggctgatctcaaacttctgggctaaagcaatctgcctacctcagcctcccagaatgctggggttacaggtttgagccactgcccctagcctaagttttgctaagttcctgtttactacattctaaaattttaaattgaatttctgtttttgggtactaagggtttttggtttgttggtttgttttggttttggttttagctcc

SEQ ID NO: 340149 - DNA, 148 bp, Homo sapiens
ctgggaaatgaacctgccctgaaatacatacacaggcccttgactctctgccctcagccttgtctcatggctcagccgtcagtagtgttcattgtgcattgattgggaggaaaacataagccaaacctttttttccttgaaggagcag

SEQ ID NO: 340150 - DNA, 1491 bp, Homo sapiens
aaaatgggtaaataaggtgaatagacatccctcaaaaggagacatacaaatggccaagtatatgaaaaaatgctcaacatcactaatcagggaaatgcaaatcaaaaccacaatgagatataatttcacctcagttaggatggctattaccaaagataaaaaataaaaaatgctgctgagaacatggaaaagggggaactcttatatatggctggtaggaatgctaattagtatagccatatggaaaacagtatgaatgttcctcaaaaatctaaaactatagccaggcacggtggtgtgtgcctgtagtcccagctactcaggaggctgaggtgcaggactgcttgagcccaggagtctgagaccagcctgaataacacagcaagaccccattttaaaaaatgaaaaataaacaaaagttaaaaatacaactaccatatgatccactggtaatgatctataccactactgggcatatatgcaaaaacaaatatatctatacgtcaaagagagatctacactcctatgtttattgaagcactattcataatagctaagaaatcagtctaagtgtccattatcagatgaatgaagaaagaaaacatggcatatatacacaatggaatactactcagccatgaaaaataaacctgtcattcacagcaacatgaatgagcttgaaagacattaagtgaaataagctagacacagaaagagaaatactccatgtttctactcatatgcaagcataaaaggttgagaatggtggtaaccagaggctgggaaggacagcagagaggcagatagagattggttaacaaatacaaaattacagcaagtaagattccatttgaataagttgtagtgttctgtggcactgcagaatgagtacaattggcaataatacattttatattttcaaatagctagaaaagcagactgtgaatgtttctaaacacaaagaaatgataaatgattgagatggatatgctaattaccctgatttgatcattactcttagcacacatgtattgaaatatcacaccaaaccccataaacattgtcaattaaaaacaataaaagaaacaaaaagaataccaaaagagaaattccaaaatattctgattaaacatattaattactacgactggactcaatccatggtgacaactacctgcatatacatatgcaggttcacctgttaaaattccagtcactttatgtatagtcagccttcacacaatcttctgtaagactgaaaaatgagattccttctctgtgtttattttctgagtttatcataatcttttaacttactttagctacatgtcttatttcatttttggttccaaattgacctctagaaaattgttgaggtgaattttgaactatttactctctctaaagagcagtaaaaaagctgagaaaccacaatcagagggaagaattaggactccctggattacattatgtacaaacagctacaatatc

SEQ ID NO: 340151 - DNA, 315 bp, Homo sapiens
  misc_feature (22)..(22): n is a, c, g, or t
acttagaggacccctttatatnggctcaaacaatcctcccacctcagcttcccgaatagtaggactacgggcacaggccaacacgcctggctgatttttctattttttatagagacaaggtttcactatgttgcccaggctaatctcaaactctcaggctaagtgatccacccatcttggcctccaaattgtcactttctaattcatattttctgtagaaggctgtaagtcccttgaggacatggtcagtgaaatcagtgattaatatttgtagccctctggggtgtagtgccttaccctagcactgtctgtttg

SEQ ID NO: 340152 - DNA, 324 bp, Homo sapiens
gatcatggctcactgcagcctcaacttcctggcctcaaacaatcctcccacctcagcttcccgaatagtaggactacgggcacaggccaacacgcctggctgatttttctattttttatagagacaaggtttcactatgttgcccaggctaatctcaaactctcaggctaagtgatccacccatcttggcctccaaattgtcactttctaattcatattttctgtagaaggctgtaagtcccttgaggacatggtcagtgaaatcagtgattaatatttgtagccctctggggtgtagtgccttaccctagcactgtctgtttg

SEQ ID NO: 340153 - DNA, 568 bp, Homo sapiens
attcatcccagtaaggtgaaacacaactctgtataccaagatatatccatggtacctcgatatacatatttgcaggtttcttttttgggaggtgtttgctataaccagttggaaatttcctcttttaaaaatttgctttcaaatctaggctttcctatccatatccttgaaatgaccttaacaaatctgttgcccaggctggagtgcagtggtacgatcatggctcactgcagcctcaacttcctggcctcaaacaatcctcccacctcagcttcccgaatagtaggactacgggcacaggccaacacgcctggctgatttttctattttttatagagacaaggtttcactatgttgcccaggctaatctcaaactctcaggctaagtgatccacccatcttggcctccaaattgtcactttctaattcatattttctgtagaaggctgtaagtcccttgaggacatggtcagtgaaatcagtgattaatatttgtagccctctggggtgtagtgccttaccctagcactgtctgtttgatgaaagaatataatttacttacaaccaa

SEQ ID NO: 340154 - DNA, 346 bp, Homo sapiens
aaaaggcacattattttatccaaattaatacaggtctcctatggagcaaaggcaacatttacaaaaacttttaaatgaaaatatcaaacttaaaattgttttttcttgcaatagatcacttgtatactaccttgagactcatagcctcactccaggaagacacagcactctcttgcaccaatgaggaatgcttacatgaaatggtttgaaaatggatacatttaaggcagaagattagatacgttaaaatagatttttaaatgtaatcaatgttttcagtttggaaatggatagatttaaggcagaggattaggcccgctaaaatagatttttaaatgtaatcaaa

SEQ ID NO: 340155 - DNA, 404 bp, Homo sapiens
cctgatgattaatgatgttaagctccttttcaaatacctgttagccatttgcatgtctgctttggagaaatgtctatgcaggtcctttgcccatttttgggtcatttcttttttcgctattgtttgaggtcctcatatattttagatgttaatcccttaacagatacatggttcgcaaacagtttctcccaatccataggctgcctttttgtttctcctttgctgcgcagaagctttttagtttgaggtagtcccacttgtttttgcttttgctgcctgtgcttttggtgtcctatccaaaaaaatcactgccgagaccaaggtcaagaagcttttcctttgttttcttttagatcttctcatttaaataccaatattaaaatccataataaaaattattcaag

SEQ ID NO: 340156 - DNA, 726 bp, Homo sapiens
ctcctgctcctccctcctcccttgcttgctctgcctcatggggagcctcttcacctcttgcattcagtgcctgggttaagggatgagaacagttttcttcctgggctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgataatgtgatagccggctatcacattatctttgggctgaaatgtatgtgtggaggtatgtaggagagaggaggaggagataagagaggagagggagaaaagcaggagagagcgcgagagagcagagaggagagagattggtctttgttgctgaatgatgcttggggtgtccttttctctttgtggttgtgtatcgactgtaacgaagagcagcgcctacgcgcctggtggggattgtttcggttcgcctccttttctttctacacagcggggataatgtatagcc

SEQ ID NO: 340157 - DNA, 903 bp, Homo sapiens
ctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaata

SEQ ID NO: 340158 - DNA, 476 bp, Homo sapiens
agaatgaggaaaggaagctacctggattaaatgatcagaataggtctatctaaagagaaaatatttaagacataatttgaagactaatcatgtgccactcatgcttagcattctggtcagaggaaacagcatgggcacagacccaaaggcaatgtaatgaaaacaggtggttgtggtttctgcccagtatcaacttacccttcttctagcaactttacattttttctctacacaaacatttctgctctaatttccagccaggtacttccatttaaggtgactccacaccttgcaccagatctcaggtctggctaatcagaacactgcatctctcaggtcagggtttagacctctgactcagtaggacctgtgagatataatttaattttactgagactggcaaatgggtggggggctcttatccaatatacttgaatttggggtgaaaagaaggccaacagaaaaaaagtggagga

SEQ ID NO: 340159 - DNA, 414 bp, Homo sapiens
cacctgcgctgccagggtttgctgagtgtggagactgaagttctttggtgtcaccccacagtcatccagagcgcagtggctctcaaattacactgagcaatctctccatgtttttaattaccccccaattatccactaagtggctcctcactttccaacaccgcatgcttgcctcagtttgccaaacctgcaatgtgcttctcccttgtagcagcctcctccttgcccaagagaagtggcccctctcagccttgaaattcctgagtcctttgtctatggcatacttgggacacacatcacaggctgcctttgtatttcactggttctgccactttccccttgaggactgtaaactccccaagggcagaggcagggccccggggatttcacagggcagtctggctcccttctccc

SEQ ID NO: 340160 - DNA, 447 bp, Homo sapiens
tttgaccttcaggaaattccactccaccagctgcacatgtttaaatgccaataataggccaagctcaagttctctaccacagagcttctgggtagcttgcaaaccagagtggacatatgtctttagcagtcttattttacctagagccctcagagaacctttctttgagaagagtgttgcctcattctatcagggagggtttcaacagagctcctgttctgcccagccaagaaacattgccacactaggcatgtgactttcagcaaatcatctacattcattgagccttgatttccacattcctaaaatgcgaataataatgtctacccgacagagttgtttcaagaactaggaagaacgaatatgaaaagagtctggtacaggggatgtggaacgtggaaacccttgtacactgctgatgagcatacaaataggcacaatcacttt

SEQ ID NO: 340161 - DNA, 388 bp, Homo sapiens
gggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgttttt

SEQ ID NO: 340162 - DNA, 796 bp, Homo sapiens
ctccggagttccagaggagcctgggcaacatggtgaaaccctgtctctaccaaaaatacaaaaacattgcccagatgtggtggcatgcacctgtggtcccagctatttgagaagctaaggtgaagcccagggagcaaaaagagggagttgccagattatttctacctccacgccctccctgcctgtcaaggactgagtcccaggaagatgccagctccagtgctttcccgctcttgccgtctcaggccactctggctggccgctgggtccctcaacatcccctgttggttcctttagcccagcctacaccgctggaaataggccctttatgagattctcttctaaatcctagaagagtgtaccctccatttcctgaagaatcctgacaagtatgtaaacattacttaataattgttaggtaaaaatactataaatattaaatttataagtaaataaaaatatttaattttacataagacaaagctaaaaatttcagtttataatttttaaacatagacaataaatttcccagaaagaaattgctgactaccaaccaaattttcatttttattttttaaatgttggaaaaattttgtcagaaagattcttatcaaccaatcaaattgtgttagcagttgtgttagtagtcacaaggaaaataatcagtcatattagttttcttactattgttcatattttgtctttcaaaaataggtgtaatgtacaaatacttcttaattagatatgcttaaataaaacatttcatattgtattgatttgggtatattgtagaaaa

SEQ ID NO: 340163 - DNA, 1043 bp, Homo sapiens
ctccggagttccagaggagcctgggcaacatggtgaaaccctgtctctaccaaaaatacaaaaacattgcccagatgtggtggcatgcacctgtggtcccagctatttgagaagctaaggtgaagcccagggagcaaaaagagggagttgccagattatttctacctccacgccctccctgcctgtcaaggactgagtcccaggaagatgccagctccagtgctttcccgctcttgccgtctcaggccactctggctggccgctgggtccctcaacatcccctgttggttcctttagcccagcctacaccgctggaaataggccctttatgagattctcttctaaatcctagaagagtgtaccctccatttcctgaagaatcctgacaaccaaaaatcaggagcagactatgtatacaagtctggaatggaggactttccattctagaagaaagagtggccattttcaactcttcttccttttgagacctcactaaaattagaggaacagaatttaaaaatacattacatctccatgataaagagaacaggaaaggaaatatcaacagacaaggggatttgacagatatttttggagggaagaaacggtggagcagaggtaattaagccgattggagagaggctgtcctgcagaccgagtgagacaaggtcctggcactggagaggctgctgcctggatccctcccccaacacaagaaatcaggaaatcaccactcctcttgccccaggccagagactaggtttctgtagacatggaaggtagaggctgcggacctggaccccagacacaggtgagaggagaggctttgcgctaaagagagagagagagagaaaaggaggtggggaagaagaaaggaaagaaaggaggaagagagaaggccaggcgcggtggctcacgtctgtaatcccagcactttgggaggccgaggcgggcggatcacgaggtcaggagatcgagaccatcctggctaacacggtgaaaccccgtctctactaaaaacacaaaaaattagccgggcgtgg

SEQ ID NO: 340164 - DNA, 494 bp, Homo sapiens
tggctcacgcctgtaatcccagcactttgggaggctgaggtgggtggatcacctgaggttaggagttcaagaccagcctggccaacatggcgaaaccccatgtctactaaaaatacaaaaaaaaattagctgggtgtggtggcgggcacctgtaatcccaggtacttgggaggctgaggcaggagcatctcttgaacctgggaggtggaggttgcagtgagccgagattgcgccactgcattcattccagcctgggcgacaaaagtgaaactccatctcaaataaataaataaataaataaataaataaataaataaagcaggatgataactgtacgcagcctatgaggttgtttaggatcattaataagattatgtagccatagaatactatgaagaaattaaaaagaataagatagtatggcagttcctcaaaaattaaacatagaacaatcatatgatccagcaatctcacttctaggtatatcccaaaag

SEQ ID NO: 340165 - DNA, 289 bp, Homo sapiens
tgtgccgagatcgtgccactgcactccagcctgggcaacagagagcaagactctgtctcaaataaataaataaatatctataaataaaatgtgacataaaacctatttcacattgttttatttctgtcatatattacctaaattcccaagatataattattatttaatagatgttctatgtttcaaattaccttactatcaaaaattaccttgagcttgactctcaagcatatctttaggacataagaggctgtgaaagtcacagaataaatattttcagagcatgatg

SEQ ID NO: 340166 - DNA, 930 bp, Homo sapiens
tccctacactttgggaggccaaagtgggaggatcaccagaggtcaggagagaccagcctggccaacatggtgaaaccctatctctactaacaatacaaaaaattagccaggcgtggtggtgagcacctgtaatcacagctactcaggaggctgagacaggagaatcgcctgaatggtgtgggggcggaggctgcagtgagccaagatcacaccattccactccagtctgggcaacaagagcgaaactccatctcaaaaaaacaaacaaacaaaaaactaagctctcctaagctttccatttcaacttgctctttcaaataaccttattttgaacaccttattggcaatatttaaacaaatacaccccagaggaattcagcacacagccatcatacatttctcagctgtacccatctcaaatttcatgcacttgataaaagaggcaaaacgtctgaattataaaaattaataataacgaagcttttgggctgggcacggtggctcacccctgtaatcccagtaatttggaaggctgaggtgggtggatcacctgcgttcaggagttccagaccagcctgatcaacatggagaaaccctgtctctactataaatacaaaaaattagccaggcatggtggcgcatgcctgtaatcccagctacttaggaggatgaggcaggaaaattgcttgaacccaggaggcagaggttgcggtgagcccagatcacgccattgcactccagcgtgggcaacaagagtgagacaatgtctcaaaaaaaaaagttccttattctcatcaaaatcctacattatgctatctaggtcctctgttaagactctgaaaaggcaaaactggataaactgaagaaaaatagatgtatttctgtgctagattattatcttacttatcgtacttctgagattaagtcaat

SEQ ID NO: 340167 - DNA, 753 bp, Homo sapiens
tccctacactttgggaggccaaagtgggaggatcaccagaggtcaggagagaccagcctggccaacatggtgaaaccctatctctactaacaatacaaaaaattagccaggcgtggtggtgagcacctgtaatcacagctactcaggaggctgagacaggagaatcgcctgaatggtgtgggggcggaggctgcagtgagccaagatcacaccattccactccagtctgggcaacaagagcgaaactccatctcaaaaaaacaaacaaacaaaaaactaagctctcctaagctttccatttcaacttgctctttcaaataaccttattttgaacaccttattggcaatatttaaacaaatacaccccagaggaattcagcacacagccatcatacatttctcagctgtacccatctcaaatttcatgcacttgataaaagaggcaaaacgtctgaattataaaaattaataataacgaagcttttgggctgggcacggtggctcacgcctgtaatccctgcactttgggaggctgagacaggtgtatcacctgaggtcgggagctcaagaccagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggcgacagagtgagacttggtctc

SEQ ID NO: 340168 - DNA, 228 bp, Homo sapiens
tctcaattcttaatttattactcaattcactactcttaaattgcagtcatggaaagaacctgtcttaagtcttaaacagctaagaaagaattttgctataaaacaaacatcagttggctgggcacggtggctcacccctgtaatcccagtaatttggaaggctgaggtgggtggatcacctgcgttcaggagttccagaccagcctgatcaacatggagaaaccctgt

SEQ ID NO: 340169 - DNA, 303 bp, Homo sapiens
catgtgattgcaaattagctgagctggctttagcagagcctctgggcagctaaaatcatccttgaaatcgtggtacatctttatccaagcagaaaacaagtggcttcaatggataagaaaagaaactacccctctccagaaataacccaaagggtatgcatgactcaaagtgtaacagcatttcctccacagtcaaagggatcagtcacttctgattgatacagaaaaaggtgggaagaacagagataattacagagagagggagaaacaagtctgaaacaaacagctcggagcccttaaaat

SEQ ID NO: 340170 - DNA, 479 bp, Homo sapiens
taagcaggcctgtggtgagaggagagaggaaaccagcaatgctgaactgacacctgatttcggatggttagatctatgtagaactttcatcttccccatcccttatgtattttgaatcttttaaatgtttctattagacttaactcttccaagctgccttccaggaaaattacagagaaactagggatgtaggagttcagagccagggctgctccatgctgatgtgaaggttactctttctttgccaaaccataaagcctctgggagcctgcacaggcctgcattaggctggaggaggaaggacctttgctgaatttgtatgccagctgaggcactttttctaatgtgtgcaaaggctcagtgtgtgcaaatgtcagccccagaccagaagcattttaagaagtattctaaagaggagaaataaccatcatttatttgagtacctattgaagcactttacatgcattatgtcacttatt

SEQ ID NO: 340171 - DNA, 517 bp, Homo sapiens
aatccaggtggtagaagatgaattgggaaagggcaaaggagtaaaggtagaggggatattgacaagggggtctccatgagtgagtctgtgggatatgggtgagaagagtgagtctggggagagaccctgagaaagcaccaaaatcccataactctggggttgggagaagagtccagtgacttctgatgtccataccaggaaatcccactctgtggccacccagattctgaaaacaccctattgtcctacaactctctaccatgaccacacctttggtcccaaggaccgcagttcataatcctgatcagagtcttaccttcccatcattaagtacacacacacacacacacacacacacagtaaaaacaaagaaaaaagtgcttgagctttttctaacttccccttgcagtctgttgtgtgagcagcctgtttatttctctggatattatgtcagtttattctctttaatggactgtaaaagaatgtaatcacaagagtgccaaatatcttggaacat

SEQ ID NO: 340172 - DNA, 447 bp, Homo sapiens
ctttagttttctgaagctcagtaagataagtaacttgcttagactcataattccattgaatcctggagttagaacccagcctgtttaatttatatccttaactaatatacaatatttctttgttggaataatgtacggaataatgtacaaattaatagtgagggtacaaatgaggagtggtttgttgttccaggaagctagaaaatcataaagaagatggtatcatttgtgttttaaaagacaaggttgagcagggatgcatggtaaatatcacctaaaaaggcatagactgtaaaactgggttctacatgtgtttgggtataggacactgagcaagaggagatgagactagagagcaaggtcacattagagcaaacctcctatgtcagagtagataataggcaatggatagaatttttagcagaagagtaatattatcggattcgc

SEQ ID NO: 340173 - DNA, 534 bp, Homo sapiens
cgggaggtggttgcctcctgtctccgtctctgtctcggtctctgtcagttgttggagggccaggattctgtcttatctccgcatcttgaagacccagcacaatgcctggcatttacaaggatcagtaaatgactgtggggaattaacccgaatgctcagaaacgcaggtggaattttctgggggtttcttacctcagttccacacttcgctttaacaattatctaaccaggccgggcacagtacctcatgcctgtgatccctgggcgtgggaggcccaggctggagaattgtttgagctcaggagttcaagaccagcctgggtaacatgacaaaaccccgtccctgtccctgagaaaaataaaatgggatggcgtggggaggagagtggcctgcacctataatctcaactactcaggaggctgaggtgggaggattgcttgagcccaggagggcaaggctgcagtgagctatgatcacaacaccccactccagcctgggtgacagaatgagaccctggctcaaaagaaaaaaaa

SEQ ID NO: 340174 - DNA, 133 bp, Homo sapiens
acagagaaggagcagagctgaaggcagcatggcagccccagccctctgggtcatctcaccagcatggaagtcccttgtggcagcagggtctgaggctctttttccttctcacatctctcgtttccttctctgg

SEQ ID NO: 340175 - DNA, 176 bp, Homo sapiens
atgcagattcagaagtgggtaacgaccagacgctgcacagtttggagggcttggaagaagacagaaagatgagggaaagtttagactattgtagagacgtgctaaatagttacaattaaaagagtgactatagagacttattaaatagttacaattaaaatggtgactgaaggttg

SEQ ID NO: 340176 - DNA, 149 bp, Homo sapiens
agttctgcaggctgggcctatgccaggttgaagggcccagaatatgggagccaaggtaccagcatttttagccagctctccaagtgagggaaagcatgatgctggcatctgcttggggaggcctcaggaaacttacaatcatgtggcag

SEQ ID NO: 340177 - DNA, 216 bp, Homo sapiens
atagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagtt

SEQ ID NO: 340178 - DNA, 189 bp, Homo sapiens
cgacagatagcagaaataacccaagtggcaagcggcattccaggcatgattggataagagcaaaaagctctcatccacactgtgacagagggtagggtggccagaaccacatgaccgcgctctccccctccaatgccagcttctggacttagaggagttttcccctactcgctcttttttttttttttt

SEQ ID NO: 340179 - DNA, 488 bp, Homo sapiens
agatgggcctctttctgtcgcccaggctggagtgcaatggtgtgatcatagctcactgcagcctcaacctcctgagctcaaatagtcctcctgcctcagcttcctgagttgcgactacagccatgaaccactgcatccagttcagccctcagagcctgcagaggtggctcatccttccctgttatgatctgaaactacccatatgggccaacaccacagagttctgtccccacgggccaaggagggcttctcaggatcctcaacttcttgcctggttgccagaccaatcactagaggtaagcctagaattgtacgattggaactcaatgacgttcacgctattcttagaaacagttgagccagtggcggtggagtctgaaggctctggaatcttttccttcgtgtggcagcaacttatttttcctgcggaggctcggtggtgcttttcttgggctcaggattgcggcttggatggctcattccctggg

SEQ ID NO: 340180 - DNA, 624 bp, Homo sapiens
cccaacacccttctctaaggcctaatctgcctgctcctcacctggactctacctctcgctcttccctggcatggtctcataaaataccaagactcgggaaatagaactcgggcgtagctggatgccaggcagagtgagccggtctgtaaccaacacaatgccagctctcatggcggtggggagaatatgcaaattgggggctgaacagcaccccgctcctcaagtccgtgggtgggaaaatcataatgtgtgcgtaactgtgttgggcgataacatactgatgttatcgcccaacacagtaaacaagatttcacctattcatcacaaagcactcagggctgccattataggtcatcaagatcaaagaacttaaacgcaaggacaaatctaaattaaccttaccttgttgtaaagcctcacggaacacaaacaagaccttgtggtactaaaaacattccaaatatctttgaatcactcaaactactcaggagcacattcctcttatcatctacttttcaagcctagaagtcaatgcaacttaataagcttagttctactgtccatatattcgaccatgtcgaatcatctgccacatctcttcctaatacctaagaacgtaaaaac

SEQ ID NO: 340181 - DNA, 557 bp, Homo sapiens
agtaagtttccaaatggaatcctcatctcacaatatctaactataacctacagggctactacagaccctggccagctttctcactcttcagccacaactttgctatttctctgattccatccaggaattctcttccccacagaatctatgctgtaacctctattaagttcataagccaaatttaagtatggctttcttctctgacctcaacatctagcacatatacctcttttaacctgctttttttcaaataatgcacattattatgtattgctgctctatcagcatataaattcaattgagaagttttcattcactacagaattctgcatctggcatacagaactcaagtatttgtacaattgttatccacaagtggtagaacagtactttccaaacttggattgcgtaggggctcttgttcaaatgtacaccaattcaggaggcacagggtataccctaacaacacatttctaataggcttccagatgacaacgtgtcaaatcccaagaattttcacctaccttcatttattccatctcacgtcagccacctgc

SEQ ID NO: 340182 - DNA, 340 bp, Homo sapiens
ccccggctaattcttttaactgctatagtttgtagccattgttatgaacctgccattatggaagataaagatccaacattcacttactcaaatatcccctcacttcccatgacaaatattttcccctgtccccacagagttttaactctgtgttcactgttgactttatcatgactttctaagtgctataggggcagctgagttccttgtgtacttggaatccttttcctttcctgcacacatttttgttattcctggagtaactgtctttgtttggttgggtttttgtgtatttatcaccaatgatccatcattctcccgtcggtctgtaattgccact

SEQ ID NO: 340183 - DNA, 337 bp, Homo sapiens
gtgggggcggagaagggtccattgaatcccatccaactgcatctgtgcccttcagatcaggattacacggggatgctaaatctcctagcccaatggcctcactttacagacaaggaagtggaggccagacaggggaaataaatttccaagtgagtaaatagagggacttcctgactcctagtccagtgctctttcccacaccacactcagcccctcagtggcactgccacttttcaagagctcgattgccacacgtggcaagcagctaccatgccagactgcacagatatttccatcatcacagaaagtgcagttgtatgaatgatactgacccttg

SEQ ID NO: 340184 - DNA, 875 bp, Homo sapiens
atggggtctcactatgttgcctaggctggtcttaaacctctggtctcaggtgatactcccgcttcggcttcccaaagtgttgagattataggcatgagccactgtgccccaccaagaatgcaatttgagaaagtcacatccacttctgatttaattttgcaaaaaaagtagccatgttataatgtccaaaggtcatccaactttacccactgaactgtgtaattttttaagggcaggaggaaagggaagaagaaatggataataaactcttctttggctgggtgcagtagtttacacctataatcccggcactttgggaggctgaggtaggaggatcacttgagccatgagaccagccggggcaacagagagagacccccatctctaaaaaagatttttaaaaaattagctgagtatggtggtgcacgcctgtagtcacagctactcaggaggctgagcccaggaggtcaaggctacagtgagctctgattgtaccactacactccagctgagggaacaaagcaagatcccattttgaaaataactggtcttgaattcgtgggctcaatcgatcaccttccttggccttccaaagtgttaggattacaggcatgacccactgtgcctggcagtaggttttaaaagttaataccaagtccctataatggggtttgaatgaaaaccccaaataatgacttccctgaaaacccatggtggtcttcatttgacagcttcataagaatcacttaggacttttgttaaaacatatagttttcagtcccactgtagaactactgagactttctagatgttagggaacctagtttataaatacaccaggtgatctactcttttaaccaggtttggaagccatt

SEQ ID NO: 340185 - DNA, 615 bp, Homo sapiens
tgaatgaaaatgaaaataccacatatcaaaatttgtgggacacagctacagcagtgctcacagcaaaagtaatagcaataaatgtataaactagaaaagaggaaaagtctcaaatctataatcaaaggtctaatatcaaaaaacaagagtaagaagagcaaaatcagcctaaagcagaagagaaagaaaataagagcacaagtacgcaaaaatgaaaacagcacaacagggagaaatcgatgaacaacatgcgtatttgaaaagattaataaaatcggcatcccctcagcaagactgagaaataagaatatacaaattatcaatatcagaaatgaaacagggcatatcacacagcaaaacataataagggaacactgcaaactacactaaacacataaattgaatatcttagatgaaatgaaccaattatttaaaaacacatattaccacaactcactcaacatgaattagatcacttgactgatccctataatgaaatgagtcctataactattaagaaaactgaaggccaggcatggtggctcatgtctgtgatcccagtgctttgggaggctaaggcaggaggatcacttgaggccaggagtttgagaccag

SEQ ID NO: 340186 - DNA, 454 bp, Homo sapiens
cggatcccgtaaccatctatagatcagtgtgaagaataaaattattagagtaaaatttggccatatgtgacatgggcattaatgatccaatgatttatatatgccagtaatagaatttacaaaggacagccaatggtgagatgctgttctctggtggcattctggtaataaccagctctcgtatggtgcttgatagtttccaaagtacttttgcataccttatgttatttgtgcctccaaggtatgtaaaggaggtttatttcaattcagtgatcgtttattgagcatgttttgtgccaagttttgtactagatcttgggaaaccagcaatgaggcaaagaacttgactccaagttaacatagacaggtaacactgggatacacgcacaaccaggagtttaagtttggaaacaataattaaggagggagactgatctataggatgtggtaatgg

SEQ ID NO: 340187 - DNA, 713 bp, Homo sapiens
tacacatacccttaagcaaattttatcttgtacagtttgagtatggggtttatgttttcttaaaattcagcaagcctttaacaggaatgtactcagtattaagtgtggtgtcagattggctgcagtgtaggaaagcttttattccatgggaaagaagtccatgatttttggagctatctattatgcagttatgttgctatagatttagttatttggatctcatgattgaaatagtattttaaattggggacatcttttgtttgggagaggttgtttagaaatgacaggtgaagaataaaattattagagtaaaatttggccatatgtgacatgggcattaatgatccaatgatttatatatgccagtaatagaatttacaaaggacagccaatggtgagatgctgttctctggtggcattctggtaataaccagctctcgtatggtgcttgatagtttccaaagtacttttgcataccttatgttatttgtgcctccaaggtatgtaaaggaggtttatttcaattcagtgatcgtttattgagcatgttttgtgccaagttttgtactagatcttgggaaaccagcaatgaggcaaagaacttgactccaagttaacatagacaggtaacactgggatacacgcacaaccaggagtttaagtttggaaacaataattaaggagggagactgatctataggatgtggtaatgg

SEQ ID NO: 340188 - DNA, 281 bp, Homo sapiens
aagaatgtgagacttacccttatagagaccgcaattaaccataaagccatagatgttctcaagcctagtatagcgcctgacacacagtagttaatgaatgtttgctcagtagactgatgggtggaacaatgagttgcttgggggtcaggattaactctggaagtggtagttgtgggaagggttgaacctgaagattagggcgactcagaactgcaaagaccagggaagttgggttctgagaaggggcaggacagagagctgactaatttgtttcatttgtc

SEQ ID NO: 340189 - DNA, 466 bp, Homo sapiens
atcgtctatctatctacctattacctattttctatctatctatcatctatctatctatctatctatctatctagatatataagaacctgatctccaagtgttgaggactgaaaatcagatatctatatgtctatgtctgcgtctatctctatctctgtatgtatgttaagcttcatttctaaatctatttctgtatctatataccaatatttacatttatacctatatcactatctgtgtatatctatacattaatattaatgtctataacaataacacatgtacactgtagtcatgtgccacaatatgatgtcattgtcagtgatggatcacatatacagagtggcccatacaattataatgacatatttctactgtaccttttctatgtttcaatacacaagtacttaccatcgtgtcatgactgcctacagtatttaatacagcaacaagctacataggtttg

SEQ ID NO: 340190 - DNA, 179 bp, Homo sapiens
gaatgggaaggaaagagggtgtaggtctgtgtaaaacccccaacgaaaagtcacagtaacatgaagaaaggcaggaattctccacttcgtttggatggcagaaaatcaacgggctctttgtagaataaacatacacacatgcacacacacatacatatccattcagttgcaaattcaag

SEQ ID NO: 340191 - DNA, 319 bp, Homo sapiens
taagttctttagtggtgatttatgagatattggtgcaccttttgtttagcttttgtttagttttgatatggctatacctgcactcatatgctatgataaacctctacagccatttccctgtttatgatctgcataaattgctataaaatctaagttttcatttattcaatgtatgtttctggtatgctcatacatacatatgtaataagcaatgaagacaaaagccctagtgtttatgtagccaccttacgtatgttaacatttagtctgtcacagttattattctaccattgaagaggctaagacagattcaataatt

SEQ ID NO: 340192 - DNA, 301 bp, Homo sapiens
aataggacgatttctattatagaagcagtggcaatttaaatgcatttctaaatataacgtgttcaaggcagtgactattaaaaattcacatctgaaaccatatcactttaatccttcctttttacactcaaggcagttcatgaattgcaaaagacatttttcccaattcattttcattgtttttttccccctgaatcttataaattgtgcattgatttatgagatgtaaattttttgttggcttttgccctgaaaagttgatgttgtatcttttccttaatttttctctcaattcaagaag

SEQ ID NO: 340193 - DNA, 1658 bp, Homo sapiens
cctagtcgaaggccgggtgtgaatcggcacgaggcacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340194 - DNA, 2325 bp, Homo sapiens
gatggagggcagtcagcacttggggcctggcttggggctgccctggagatgaccatggaaattgggttggcctcctctgatcggagggtgggagttcagggttcccagagctgccagaaatgttcacgtcccaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340195 - DNA, 2352 bp, Homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340196 - DNA, 1776 bp, Homo sapiens
ataatagctctggactctgcagaccttcaggttgaattgctgggtgaaagggcccaaggtgaattttgacactccaggtgtccccaggaaggactgctcctgggatgataggccctagagggggctccccgtggagagggggatactcatgggtctccctcaccccctaccccacagctacccctgtccagcagccacctgaatgtgtacagcagcgacccccaggtcacagcctccctggtgggcgtcaccagcagctcctgccctgcggacctgacccagaagcgagagctcacaggtactgcctccctctacccctgtgcctttgaatacccgactcctccctccttttctccctccctcccagctcctctctccttctcttttggcctccagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340197 - DNA, 1048 bp, Homo sapiens
  misc_feature (46)..(46): n is a, c, g, or t
caacggggggagacagtcaaatcaacgggctaggtacgaggcctgngtgtttgcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340198 - DNA, 2331 bp, Homo sapiens
ggtggagtgacagccggagcccgggcgccggcgcggggctcggtgacagcggaggcggcggcccgggcgggacgagggagcggccgcggcgccgacggcgggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340199 - DNA, 2158 bp, Homo sapiens
ctggggctggggtgcggccctgggctccggcccctggaggagctgagcattccaggggcctccttccaggggctgccctctcgaagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340200 - DNA, 2052 bp, Homo sapiens
ctggggctggggtgcggccctgggctccggcccctggaggagctgagcattccaggggcctccttccaggggctgccctctcgaagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtactgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 340201 - DNA, 121 bp, Homo sapiens
taggaaataaagcattactgttttttactcataaagagatgaaaataaaataaattattggtcaattctttatgagatttaaattatcttagcatttatttgtttgtttttgagacagggt

SEQ ID NO: 340202 - DNA, 780 bp, Homo sapiens
gggagaagaaggaggaatggctcataaatgacaaggacagtaattaataagtaaatacggtgtcaaatcatcctttcttttgaagactaatgacctcaaagggatcaaacccagaaacagtttttatattttttctgggatcaaatacatgggtatctggcctactatatttgtattctagactgtttagtaaaataatacaggaatttgagaaaacctttgcaaaagtgttagtgaaaattacttagggtgagaggaagtgagggatattttattaggggaggtcacaagggcagtgagcaatcagatttttagtaatctgacttaagcagtttctttttgttttaatgaagcttgttatctttataaaagtaattagagaaaatttggaaaataaaggaaagaaagaaaagttctttagtgttttatcacgcaaatacaagctcattcgtttttaacatcttgttccaaactccaaagtcttgctttctcttcaattaaaactttaatgggtggatgcttttcctgcttccagtatgttatcttaataactaacaatggtatattagctaatgtttacaaatgtactccagatgttccttaagttactttggtttatcattaccaatttatattgtttcttttagaaatttataatctttgttaatgggttctgctaaatttggtagtgaaaatgggatcttgagaaaaaagattctgaagcaacagaatttttagatttatattggtttacataagagttggtagctgtattacttt

SEQ ID NO: 340203 - DNA, 265 bp, Homo sapiens
caccattgtcgccgataattatggttccagaggagccacttcacccctctggactctagtttacttactctccaagcagggcatcgtccccttgtggggttaacgggaaaattaaagttgacaccatgcatgaaatgctgtccaaatcttgaccatacaattacagtgggtgttctggaagtaacagtcgtaagaatcctaatgacggtagctatccctgacttgtccatagcatttacagtttacaaagggcttcacacacccg

SEQ ID NO: 340204 - DNA, 195 bp, Homo sapiens
ggactaattcataaacacaacaaataagtatgctcaagggatcttagtgattttcccatttagtaataggagtagtttagatagaactagtgactaattttttattagcttagtagcaccactacccaagaacatttgcatcagggatataggctgaaatgtaagaactaagaagcccatgtacctaggacacac

SEQ ID NO: 340205 - DNA, 443 bp, Homo sapiens
tagttgtcccctccagtgatctgacgagtctaatatgtagcagaagctgggaaccactaactgttccttttgttcccccagctccaaagacacctcctcatctccttgtagaaaggagatcaagactccttattcgtccattgcagagctaaggaaaccagggctcaggaaggttaagtggtttgctgctaagaggaagggccagaaacagaatccaaaactccggacccggggagcattcaaccctggcttaatgtgcttctactgcatgccagccactgagctatccattaaccaagaatagaaaagacgcaggaaattatgccattctattacggcacaggatgctatggagcctgggctggggaggtggggaaggtgtttctaaacttcatttgtaagctgaatcttaatgccaagaagacgtgaggcgatggtgaggg

SEQ ID NO: 340206 - DNA, 610 bp, Homo sapiens
tatctcatctggaggtgtgtgatgtttagtgatattaattttgattacctgatcaaggacttgtcctatttctccactgtatagttactatttttttctttgacactaatgagcagtgagtggggagatagtgtgagaccatgcacatcctcctcatcagatttcccctagccaattctaattttatctaaactttattagatcatcttaagataaaaataattttctcttgaggccttaattggcaagcagatttaactactctcttttgaaattgtttctctagcaaggtgagcagtaattaacaaacataaaattactatacattgaagctgcactaaaaaaaatgccataatggttaagcttttttccactctaagctgtgcttctctctatttgtatccggttacctccccattagaaaagccatcaccattttattataggaaaaacaatcagttctttctcctcaggcagtttctaatgaaaacggtatcaggtatcagagatactaaacatttaccaaaagcttaaatattgatgaaaatttttactaagcaagtgaaattttttttaatttggtttttgtaaacactggcaggaaggtgga

SEQ ID NO: 340207 - DNA, 304 bp, Homo sapiens
ctgaggtcaggagtttgagaccaggctggccagcacggcgaaaccccatctctactaaaaatataaaaaattagccaggtgtggtggccagtgcctgcagtcccagcttctctggaagctgaggcaggagaatcacttgaacccagaaggcagaggttgcagtgagctgagattgtgccactgcacttcagcctgggtgacagaatgagactctgtctcaaaaaacaaaaacaaaaacaaaatgcttacagtatcagagctcacaaaggcagagtattgctttattccaactcagggcccttca

SEQ ID NO: 340208 - DNA, 540 bp, Homo sapiens
tgtttcaagaagcaaggacatttaaatgaaaaaagaagaggaagaaagccctctgttaatttgaagctgagcatctgatccactaaaattgacaaaataaatagcataatcgtatacctggggattcatgccgaaacttctgaatcagacaccctggggctgggaactagtcagccagggtgtcttctggatcacacaccctggagaatgtggactttaacatttcttctgagtaattttggcctccagcctgagtaaggatagttctagacctatagttcttaaacctagatgagtaattataagaattacctaggggaggagccaagatggccgaataggaacagctccggtctacagctcccagcgtgagcgacgcagaagacgggtgatttctgcatttccatctgaggtaccgggttcatctcactagggagtgccagacagtgagcgcaggtcattgggtgcatgcaccgtgcacgagccgaagcagggcgaggcattgcctcacttgggaagtgcaaggggtcagggagttcc

SEQ ID NO: 340209 - DNA, 136 bp, Homo sapiens
atggtgttctctctttgagctggcctccgcatctgcattctccctctttatgagggagtcaggacccaccctactccagtgtgacctggtctaaacctagctcatcacatcttcaacaacccttatttccaaataa

SEQ ID NO: 340210 - DNA, 513 bp, Homo sapiens
gtccactaatcagggcagtgtggtgtgctattcacaagctcataactggcagtaaaacagaaaggcccatgtctgctctgctgagtaatttccacactgaggccctgagcagagatgtcgtgtcatttgtaacatctgccttggcatccaggagccaaagtaagctagttagggagttgcactacttctttttccctcttcctgtgacaagcctaaaggactcaaagttatctgcaaggaaaactagtctgagctcttcagagaattgtcagttcaatgaaggtaaggcagaagagtgtattggaggctaaggagatactctggcttctgatttacctagaagagagggcagaagtagcatcagatgtggaaggagaaaccaagtatcaaagcagaaacagacactctggaggggagatcttcacagctgcacaggaaggaagactcagtctttatgcttcattaatttttttttcatataagactatgccacaatgatagttatagaactca

SEQ ID NO: 340211 - DNA, 685 bp, Homo sapiens
cttctagtcaacagtaagttattaataaagtttttgaggagtcaaaagttataagtggactttcaactgtgcagggggttgtcatccctaacccccacattgtttaagggtcaaccgtactatatacacctatagctgctggtatactggggctatactatctaatacaaaactgattctgaaatttacaacttttaaaaagacaaatatatttccctggtgtttgataagcatcatgagaactattttgcctaaaaattaataagtattagttgcaacatggacatttatactaataaggagggcagaggcgaatatgtgagaaggtccaccacctcagagcttgaatcagcttcacgatgatggaaaggtaagctttatcactgatctcaacagcagactggtggcaaagagccagccgtaacaaagtactacaatcagaaaaataactctagaccatctcatggaatctcaatctaaattatcatttgacctttcggcattatagcaaaataaggtctgtatacactggatactcccatgtcctatttctaaccattatgactatgtgtcccagaatggtgcacgccaccacatttaggaagaactggaaatgcaaatgattatctatgatgaagactcacatagtcctgaaaagcatcatttaattagaccttgaaatggt

SEQ ID NO: 340212 - DNA, 647 bp, Homo sapiens
cgtactatatacacctatagctgctggtatactggggctatactatctaatacaaaactgattctgaaatttacaacttttaaaaagacaaatatatttccctggtgtttgataagcatcatgagaactattttgcctaaaaattaataagtattagttgcaacatggacatttatactaataaggagggcagaggcgaatatgtgagaaggtccaccacctcagagcttgaatcagcttcacgatgatggaaaggtaagctttatcactgatctcaacagcagactggtggcaaagagccagccgtaacaaagtactacaatcagaaaaataactctagaccatctcatggaatctcaatctaaattatcatttgacctttcggcattatagcaaaataaggtctgtatacactggatactcccatgtcctatttctaaccattatgactatgtgtcccagaatggtgcacgccaccacatttaggaagaactggaaatgcaaatgattatctatgatgaagactcacatagtcctgaaaagcatcatttaattagaccttgaaatggtaactctcatatcttaaccataagaccgtaaatgaaaattaaactgtactacaaaggttatcaattataatttctaaa

SEQ ID NO: 340213 - DNA, 303 bp, Homo sapiens
tgatgagacagattatgagaggatgctgaagaatcggggggattgtgtgttcccttaaggcattgaagagcagtcttggtatatgtgatagagagtgttgtaggataaaaacgtgaataggaaaatcagcagtagaacaaaactaaatgggactaaatgtaactaaaaatgaatattctattcgaactgcatggtagagataagaccctttgaatgatagattccgagaacattagtggtggggtagagaattggggatgggatagaatcccaaataacttcagttattaattagctgctaat

SEQ ID NO: 340214 - DNA, 225 bp, Homo sapiens
ctaatataaaaatacccaaaggatataagaagccacttaacaaaagagaatacagagcaacaagacctcttctgcagtgctgagtggaaagtaagtggtgctacaacttggaaaaacagtttagcattattcagtttcattcctacgtttcttccatgaggaagcataactatgtttataaaaacaagtgcacaaaattgtacagagttgcactttccctaatag

SEQ ID NO: 340215 - DNA, 327 bp, Homo sapiens
aatgtaggtctcatggaagattttcatgtggacaaatttagtaaattttttgcaggtagtttcctgacatatttaacatttgtgatatagtaaacaataagaaggtactaaagtgctgggattacaggtatgatccactgcgcccggcctccaagccccctatttttattttgcactgaccctacaagttacgtagctaggcttagttatgcttttagcaaggaaagtgtataatctcatgtaccttttgaaagattactcaggtctctgcatgtgaaatggaatttagggaatgcaagagagggagtaaaaataacagcgaggaag

SEQ ID NO: 340216 - DNA, 217 bp, Homo sapiens
aatcaggagcactggcagtgggctgcagtgggaagggcatggagctagaggaaggccaccttccctcaggtacgtggttgtcccattaggccagagagcaccagaacgaaaagtaggtggacatgtttagtggggaggctgggagaagtgtgggttgcaggagggaattcttacttgacagtaacctttgaggtttgagatgcctggtgggaaccca

SEQ ID NO: 340217 - DNA, 147 bp, Homo sapiens
aaattcaatgcaattcccattaaaataccactatccttcttcatagaaaaaaatcctaaaattcatatgaaatcaaaaagtgattgagagggcctaaaatgggacagcagttttggaaaggaaaagatggatttaggagcctccccc

SEQ ID NO: 340218 - DNA, 1278 bp, Homo sapiens
cgcaacctccgccttccaggttcaagtgattctcctgcctcagcctcccgagtagctgggattacatgcatgtgccaccatgcccagctaattttgttttttttagtagagacagggtttctccatattggtgaggctggtctcgaactcctgacctcaggtgatctgcccacctcggcctcccaaagtgctgggattataggcatgagccaccacacttggcctacctctctactctgccctaagatgcttttgtgggtaaagtgaaaatcacataacagtgcagcttcatcatcatatgccctcaatgttcatcactgttgataaacatgcactgtattatgtttctgtgtgcctttttcttgtgtgccaagtaagacccatggcaggcaccttcattttcaggaagcgaaaatacagatacagtaatatggaaaataggacaaagtgtggacttcaggatgaaaatattgtaacaatcttgctgttgacctcgtagcgctcagtgacataatttgaaaaaatattaatgttcagaaatgttctcttgaggatgaacacacagattgggaatttcgttttgctttggtagattaactagaaacttcacattttcacccttataacctttttggtaatttgaacttttgatcattcttctggaactgctttgacatccacctgaagtttggtttgggtattgagaatgatgatgccattcactaatgtgatctcaaaatgtttactccataatgaggctttctggggagagcagggtagacttccccggttggtccaaatatgactagggaatcggcataggtgactggcttggggtatgatgattgttaagggatagggcttgggcaggggtgcccacttgtggtttgaactttcagctggtgccaaaggagtgggcactgaggatttttcagttgaccagatgggcagaataggaagagggagtgcagaggtgtaaaaggcgttggtgttcagacatcacaaaatgcagtcaactctaggacaactctagcttcctctggaagctcctgccatcttggttaggaaagactctgattttcttcatgataatatcttacgttccttttatagttacagatacaggtctcattgcacaatatgattgttgaaaacacttgtgaaatttttttagtaaaattgcctaagatactttttatagtagacaatgaaaattagtgtgtgggtttataataaatataatgtattatataatatgattaaaatatatttgttata

SEQ ID NO: 340219 - DNA, 355 bp, Homo sapiens
tatgtgtacatatagatatggatataacataagtaactaaattaaaacaaatgtccataatttggcccaattagaaatccagaatgtatataccaaagaatttatattacaaaaagataaaaggacattgattagattttttgtctctacaacataaggtctaaattaactttagcatttgctaaaatataccagctgacatacttcatggactcaatcaatactggggctccaattatacttggagtgggccgtggtggcttacacctgtaatccaagcactttgggaagccgaggcgagtggatcacctgaggtcaggagttcaaaaccagcctggccaacatggtgaaaccc

SEQ ID NO: 340220 - DNA, 409 bp, Homo sapiens
aaggtccatgcgagaggaatagtaaactgaagccacacggctgccgtgtatgcaaagggagcctgcagggtgagtttcgtaaattaaagcacctctcggtgtagacacacacagactgacttctgcttggtcacagcttccaagcctcagggtaggtgcaggctgagggacaccaggtgcgagcattttctgtttcttgtcatggcaccagtgtcgttcctgtcacccacggcactgagctctgccctggtaacgtccctccctccctcttaggctttggccacctgcattgttgtgctactgggtctccctgctaaaggttctgcttcctggttcctgcaagagcagatctcagtttttctgttgtgttgttttgttttgttttgttttgttttttgttttgaaacag

SEQ ID NO: 340221 - DNA, 136 bp, Homo sapiens
gattgcatccccattgcatcatctgggctcatctcatccccacctctggactgtaacatcatcccagggactgccggacactcatctgtgctcccccacagagagtataatgccatttggtaattcagtacaacct

SEQ ID NO: 340222 - DNA, 281 bp, Homo sapiens
tgagttatatctcaaattattcctttaagcagtaaatgcaattgaaaatttttggaagtttcaaaaaagtctaataaaatctcacaataagtttatccatttactagatgaaaaaatatatacactctggatgtgaatttgtacattataaaaccaaccaaatggagaacagaaaagaaaaatggaaccaagcagctgacttgtataaacaatatcatacaagaccctatagctgaatcaaacgcaattatacaaaagccaggaggggctgggcatggtgg

SEQ ID NO: 340223 - DNA, 258 bp, Homo sapiens
tataatgaaacataatgtaaaaatacctcgagtgtatttgtattttggtaatatctgaataagacataaaatataacgcacacatctttatatcgttttatccatatctctctttctttaaatccttctggttaaaatttgtcattgcctcctgactatgtatttattttttcttttctggaagaaagctcacctaggccttactcaaatgcatgttctcaatctttacctaccacccctcctgcctttttgttccag

SEQ ID NO: 340224 - DNA, 263 bp, Homo sapiens
aagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgctactcgttgtttatgtttattttatt

SEQ ID NO: 340225 - DNA, 241 bp, Homo sapiens
atcccatcttgaatattaaacaacaacaacaaaccaagatctgggaattaggtgtgctggtggctgttggtgtgttgcttctaggccgtctcagctgacagagcaagtaaatatatgtgtggatgctaacccatgtgtgtatacatatctgtagatatttccatatgcaactgcttgtatcttccttaaaccaaaaacttaggtcattctagcttcctcctcttgcttacctggaaacttc

SEQ ID NO: 340226 - DNA, 334 bp, Homo sapiens
caacactaacgacagctgacgcgcttaaaaaatagtcgcaaaaaaatctcataaagttggctgggcgtggtggctcatgcctataatcccagcactttggggggccaaggtgggtggatcatgatgtcaggagttcaagaccagcctggccaagatggtgaaaccccatctctactaaaaaatacaaaaattagccgggcgcagtggcaggcgcctgtaatcgcagctacttgggaggctgaggcagaacaatcgcttgaacccgggtggcagagtctgcagtgagccgagatcacaccactgcacactagcctgggcaacagagcaagactct

SEQ ID NO: 340227 - DNA, 290 bp, Homo sapiens
gtagatcatctcaggatgacctgctcatcatccttctggacaaaccattttctggaggatccgcggttgcagatgaatgcaatgtgttgaaaggtcagtcttcaggactttggtgaaattgataagaccgtggcttagatagatcacgctagccatttaccacaagggaaaacatccaagctacaaatcaattgcttcagttctgctttcccaagatattaccatggcatgatgactggattgggggcataatcatagtctgttggcacccctgcacatttgcctcctcc

SEQ ID NO: 340228 - DNA, 677 bp, Homo sapiens
gggctctgtatatttctctttcggaaccacctccattgacccttattacacaaaccctgactgagccaaggagcccaaacagtgcagatctaagaactttcgaagactacctgccctgacagctatttcaatgctagcggggaatttcagcaacaaccaatttaactgagcacaaatgatgtgctgactgaagtttggtaaaaagcatgtagttgagattcaaaagtaaatgctgtctcctctctgagttgcttgtgattgttaatagactgaaaactgaccaaattggcaagaaagcaaatagttttacttatatggctatacaattatcctcaattactaaattcagttggtgagcaccataattactttgtaatataaagggcaacctggggagaagagatttttttttttgttgtttggaggtaagtggccataaataactaaatcagaaaggatacagcacggatatacagtttttgttgttgttgttgtttttaagtatcagaaaaataaatacaacctttcaggatgctttgcaaatgtagggattttgtcactaatagaagtctttgaaatacatatctggaatgacagcaatagtcagtcagtgtgtgcttcaggatgaatttatgacctgaatttggtttcccatgctttctttaacactgtgctac

SEQ ID NO: 340229 - DNA, 439 bp, Homo sapiens
tgacattcccataacagtgtataagaatcccttttttctgcatccacaccagcatttttttattttttgtctgttagtaatagccattctgagtgaattgttacttttaagctcttatctctaacaatcaaattactataacagatttttgtttcactttcatttgtttagattagtagttctcaatgtggaaggacctgatttaatctcccaaagaatatttggcagtgtctggagacatttttggttgtcttaacccaccaaaaacagttgtcagtgctactgacatctagtgttacccactactgggttgctgtgaaaattagttttcagaacagagccccataaaaatgaattatctagcttaaaatgtcaacagtgccaaggttgagagtagtgttttttaaagaatgggtaggttgtttatgtttgatggaag

SEQ ID NO: 340230 - DNA, 347 bp, Homo sapiens
gcttcctgaaagatatcaaaccccaactttgtttttgcagatattcatatgtattcttgggcaagatttctttccctgggctagatgtcccaaggaccacactcctctgtccctttcaaagaaaagacagacctcactgggaagtcctggattgtgtccactgctgctgtcaccggagtctgaccccagccctgcccatctccagggatcgcagaacctgccagccaacttcctttgagtcagccggtcagggctgcatcttagaagccaagctgctttggtgtgatttctgaagtctgtgcatttgccttaactgtcaggccactggcttccctgagactggtttc

SEQ ID NO: 340231 - DNA, 325 bp, Homo sapiens
acccccaacacaaacacacagacacacatcggcactacagagattggtctgtgcactgtcagccttagagcccagctgcccaaacccttacttccctattctctcctgtagcttcctgtcaccatggtctctcagtaagttttgtagttaattttagctgctttacatgtatccaacaatttcattctattttcattaaaattaactatctatgaaaggctttggaggaaatttgtgaattttttctctttttgctcctcttctcacttttcaaacctgtttattgccctttgctaataataatggtaaagactacgatttgtgt

SEQ ID NO: 340232 - DNA, 1080 bp, Homo sapiens
tggctatgccctgcccccagaggtggagtcttcagaggcaggcaggcctccttgagctgcggtgggctccacccagtttgagcttccgaacctatcttcttaaaatggtggttgggaaccaagagaccaaagccactctggtccattaggtttttctgccttcacatgtaaatatctttagtggagaataagttacataaccctcagatatgagggaagaaaattcactcctggagaaatcctctagaatacatcaagcactttctcttattgggtcaaaataatgttactaactggctagccaacctgttttctatgagatgcatcagaaccctgcctgactctggagctctggccacatcaataggtaagattccataaaatgtgctatttgatagcatttgatacaatatttaatccttttattatcaagaaaagtctgataatcttattaaaactcttacttcaaaacacacaagattcaaatttataattttttttattcctactacataatcagtttagtattcctcccttcccagccctgattttcttccatgcccacttcatcaaattattttcaaactgcccagtaattttccatgtgactttaacttcttttttcactccctccctttctcttctctccctctctctttctcacacacacaggcacacaaacacaaaaatgcactctctcacacacacacaattaggaaattactataaactcgatctagaagttggcaagtttaagtcagttttcacatggaatggttagatggtagaaaaataggaaagaatttgtctgaaatctgcaaaacactaaataataatcacctgaaagggaaaaatgagtctatacagttataaactatcctccacagtctttttacatactgtactaaaacccagaagagaaaaaaaggattttcttagtaacttattttttgttggataatccttctaaagaaaactgtttatatcaattatactttattctattttctctacaacttgactgacaagccacgaagtggccaaatgaaccatgcaaacaaaaattctaacaaggtagag

SEQ ID NO: 340233 - DNA, 598 bp, Homo sapiens
ctccttgagttgtaggactgaggtcttcatttccttgcttctgtttgtggagggttgctcagctcctacaggctgcttttccatccttgcacatgacctcttccattttcaaagccagaaatggtacatcaaatctttctcacactttgaatctctatgacttccccttctgccatcagccagaaaatgttctctgcttttatgggctcatgagaccagatggtgtctacccagataatctccctattttaaggtcaactgtgctgtataccttaacataatcatgggagtactacctcataacattcaaaggttccagggattcaggtggaacatttttggaggcacatcctagaacttctgcctactaccagtgggtatccaggtctcctaggataggggaggccagaaacattcagcacattggacactttaacaagaactaggctacttcagtctgcagaacagaagaaaggggtaacaggttctacattcttcaaagactgcatgtagaagaaatgcttatacacgcattcactccacaaacaagattgggttcctgtcaggtgccaacacatgtgtcagatgttggaaatac

SEQ ID NO: 340234 - DNA, 753 bp, Homo sapiens
gaagttgtctttgctagatgacatgatcacctagaaaatatgaaagaatgaccaaaaaaaaaaaaactggatctaaagtgattatataacatggttgcaggaaacaagtttaatatacaaaagttgatcacttttctgcataccagcaatgtacaagcagaatctgagataaaaatacattaccattagcacccccccaaatgaaatatttatgtataaatctaatatgtacatggtctatatggggaaaatgcaaaattctaatgaaggatatccaagaaagagatgttccatgttcatggataggaagatgtgtattgtcaagatggcagtatttctaactcaatctagaaatgcagtgcaatctatcaaaattcctgcaagattttgaggatactgacaaagtaattttaaagtttatatcaagaggcaaaagaccaataaatgactgtatatatagccttttcagactgctttttttacttagtaataggcaaaagaatagccaactcaatactgaaggagaaaaacaatgtcagaggactgacactacatgattgcaagacttactctaaagcctaagttaacaagatagtgtggtattggtgaaagtctagacaaatatatcaatggaacagaataaagagtccagaaacagaccacttaattataatcaactgatctttgacaaagtagcaaaggtaatacaataaagcaaagatagtctttaagaaatggtacgggaacaactgg

SEQ ID NO: 340235 - DNA, 206 bp, Homo sapiens
atggggtgcaagcttcacaattgtgacgacaattctcccaaattgatctcttataaattcaacacataccaataaaaataccataaagattgttcagtgtgtaaattgacaacgtgattctaaaatttagaaagcatgtagaattatcaaagcagttttaaaaataacaatattgttggactaacagtacctgatcttattactta

SEQ ID NO: 340236 - DNA, 288 bp, Homo sapiens
gagtgtcctggcatgagggcagcctcactgaggtgaggcagggtatttcccgtttcccatctgcctggccgtcttcccactggcccttggaagagagagggcatgaactcctggctgcgtgagtttccttcttactagcaactttgtttaggagttgggatgggcgtagggccgctattgacgggggagcctctgtggtttccagggcgtctgcatccacgccctcctaggcccactcacagctgcagttgactcattggatttcttcttaagtgacaaatgaagcca

SEQ ID NO: 340237 - DNA, 399 bp, Homo sapiens
gagaaaaaacacaagaggatggtaactagaacctgggagaagaaaggtattctagaagaaggaaatgatggactctctaatgctacctggtaggtcaagttaaagaaagtttaggaattcatcattgattttagcaaatgtagtgactttaacaaaaacaggagaaattcatcatttgaaacacagtagaggctgcagcagtcagggacatttctgaagtgaggatctttgatgcctaggtgctacccaagccatatatgaagctaccttaatatgtgagttgtgccattcacagcaaagtagttagaaatcaatctcatgaaggctgctaggactgaatacccacacctccatttcgacctgcaggcgttgccccatgactcccactaaaacccgtta

SEQ ID NO: 340238 - DNA, 268 bp, Homo sapiens
caaccgcatggacagaatgatagatttttatcagatcttttcctgttctgaagaaaaaaagagtatttgttcactttaacatgtactttacaccttctggctagtagatcacatatgccatctggttgggtggcagaaagtgatcataaaatgatgaaagattcagtcatcttttgcaacctatttatatgttttatatttaagcacattatcaggctgtatttatggatattatttttaacccggacacatgcttgtgttaagcttg

SEQ ID NO: 340239 - DNA, 436 bp, Homo sapiens
ggaaaacatgctgcttcttcaaagactccaatttcagatggcaaaatgcatggaagctgagatggaccttctggagttttcgataaaccactgtagctcagtcagaggtccaattatgatgatacccacacagcccggtcctcccacagcctacatccaatcctctgaggaagctgagtggcactgcctttattcaccacagatgctacagaatcagcaggaaggaagactgtgaaaaggaaaaatgcactcttttaagagatggagtctgctatatttcccaagatggacttgaactcctgggctcaagcagtcctcccacctcagccttccaagttgctggaactatataggtgcacaccactgtgtccggctaaatttgtgtatttccatggatgtataatatatttacatatctactatctttcatcaaatt

SEQ ID NO: 340240 - DNA, 236 bp, Homo sapiens
ttttatttggaggtagtttccaaccatcaccaacaggataaatctacagaactcaagggggcagaaacaacgggtaagaaaaatgactgtactgaactgggaaatttttcaaggataacctgtagaaaaccagcctaggaaaaggcactttttttttttttttttttttttaagaaattaccgtgtaacttcttggcaacgtgacattgcttaacctgttattttctcctctatag

SEQ ID NO: 340241 - DNA, 610 bp, Homo sapiens
cagacactgaatccactggcagaagaacaggaattctcaaaccagagattatcacttttacaaactagaaaaactacaagggaaataaacactacaaaaatgagaaactaaatatctgaagaaagagttgcaggaataaacagaatcaaaaatattctcagaggtaaaatcataactcatccataaaaaaagctaccatagagaaaaatcaaaaattaaaaaacgattgccagatgtgtgtggctgcaaaaattaacacgataaaattatatacaactaaataaacaacgtacaaaagaatccatgcaaaactgtttctatttatttttcaccttttatttttatttttagagacagcgtgttgctctgtttcccaggctggagtgcaatcacaactcaatcacaactgactgtaaccttgaactcctgggctcaagcaatcctcctgcctcatcatcccaagtaactacgactacaggaacacaaccatgccagctattttggagagacaaggtctcactgtgttgtccaggctggtctccaactcctggcctccagcaatcctcccactttggcctcccaaagtgctgggattacaggcctgagtcat

SEQ ID NO: 340242 - DNA, 301 bp, Homo sapiens
tttcaaatacacatggactgcactaacaactttcagactaaaccacatttcactgttaagcgttatgaaaaggagttaatacatatataccatttggtagaacctatcaaatagtaagcactatcaatgttgttattactattattaatatgtatcaaattacagccttttatttaaagcctaacagggtatacttgagacaggcccaatgggactttaccttactttatctaatggggctgttgtgtgaggattaaataatatacacagggcacttagaataatgctgacttgttaggtc

SEQ ID NO: 340243 - DNA, 346 bp, Homo sapiens
actgcgcccgccctagcatggcatttctaagcataaagatgtgaaagatttatctgttcctcttcaaaatgacaatctcaaaaatcataacagtctaaagtaatcccaacccctttttcccctatgtgttgactaaatcacttatcaaacacacataaagaataagtcaacaatgtgaaaaaatttaatgcataaataaaagattgaaagggaacaaaaagaaaatgtttagacaaattactgagattcaggaagacatttctcttttaattacaattaacttacaattagttttgttttactgaactacaaaaaaagattctaaagagcctaaattacatctatt

SEQ ID NO: 340244 - DNA, 499 bp, Homo sapiens
aacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagggcaagacttcatctcgggaaaaaaaaaaaatttcgaacacctgcaaagttgaagtgaatggtggagtcccctcgctcacacctgtggtccgctccccaaagctatgctgccct

SEQ ID NO: 340245 - DNA, 374 bp, Homo sapiens
aggatcgatgaaaggtggtaagtgattcttcaaagttctcaaggaaggagaaacaacgggatcaaaggctcaagggaagggaaagcacgagccgcgtacagaaagaaggacttctcttcggtgtagtcagaaggaattagagaagtatgtgtctttacatacactagtgcagttttctgaaatggctgtggggagcagggcctgggaaaagctatttccagttgcagagatgcctttggtgtatggagtctctgtcaacagtggttctcaaacttgactcagccttggactccctgggaagcttttaaaaattctgatctccgttatgccccatgccaattaaatcagtatctctgtggtggaacacaggcatc

SEQ ID NO: 340246 - DNA, 214 bp, Homo sapiens
ttatgtaaaaatatacatgcttttattcacagaaataatacactaaaaagaaaatgtttaaagtgatcaatgtctattttttaaaaagaaaaaaatcatttctttttttttttttttaaagaaacaaggtctcactctgtcacctaggctggaccgcagtgatgtgattacggctcagagcagcctcaacctccaagctcaagcaatctttctg

SEQ ID NO: 340247 - DNA, 2637 bp, Homo sapiens
  misc_feature (1)..(1): n is a, c, g, or t
  misc_feature (3)..(6): n is a, c, g, or t
ntnnnngcaagctcggccctcccctggaatctaaagcctcctcagccttctgagtcagcctgaaaggaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagttgtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagcctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattgcttcctgtgtaacatctgccatttatttcctcagctgtacaaatcctctgttttctctctgttacacactaacatcaatggctttgtacttgtgatgagagataaccttgccctagttgtgggcaacacatgcagaataatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacttgagtataagataaaataaaattttattttaaattttgctgagtgttatgcctattgattttacatttatagaatcctataaatcagaattggagatgtgagtgatttcctagtcttctttctcaccagtgcaggaatcctgactggaatggttcacacgttagtaaggatgctgaatgcatcttatttcaaggtagggtattcccactgtacttttgagcagatccagtgagcagctgagatctgaatacaatcattgggcctatatgttccctctgtagcttcactaaacaagtcttgggtgcaggacttgggtagataaaccatgagggagactctatactgtaggctctctcttaggaggagggaaccacagatacttgatgtgtactgatgacagattctgctagcatatagatctgtgagcattcaactgtgcttcattgttcagaggcagtaaagtggct

SEQ ID NO: 340248 - DNA, 408 bp, Homo sapiens
aaaagtaaaactacaagctacaaacttggagaaaatatttgaaacacatatagctaacaaaagattagttttaaaaatatataaagcacttctaaaataagaaaaaactcaatagaaaaaataggcaaaagccacaaagaagcatttcatagaacaagaaacacatacaactaataaatctataattagatgctcacctcaccaataatcatgaagaggcatttcatcaccatgaaatgcaagtttacacccatttaacaaatccaagaggtttgacaaaaccaaatgttggaaatcaacagggtctcaaacatattgctggggggaaactggaaaacaatttggcattatctattaaagctgaacgctggcatacacacgaaatctatttgatgtattccctatttc

SEQ ID NO: 340249 - DNA, 378 bp, Homo sapiens
ttgtatccggggaggatttctaaagaagcagtcatttgtcaatctgaaatttttttttaaaggaagaatacttgggttgggcttacaagaaaaataaattgcagtaagtgttaaaacttgccagtcaattacaggaatatattagtgttccatcgtagtttctaaaaccagacaaaatcatttcttgcaagcaggtaattccacagaagtttccaaacccatgagtttcactctcaggttccctctaggagcagaagtgcaggtttgcttgggctcctagcctctccctcagctccctcttttccctctaatggatccctagatgctactgatggctcccctaactgacggcaaattgcttgtgggcagggtctgtgc

SEQ ID NO: 340250 - DNA, 739 bp, Homo sapiens
ccaactgttgaccaggtgtcatttccaccttgcagtccaacttctgtgggaggtggacacggggaaagaagaccaccacggaggggatggctgtatgtgtgtagaggaagtattggtagtagaactaaagattctgccagcattttgtgtccaacacagttgctacatgtactataattatctcatttgtgtgaaaattcaaggatctgcattctgctattttcatcaggctgagcggagatgctgaggaatatggcaagaagttggggttcaaagtctgatgccaaagctagcaacccgagaaataaaaccgctgatcaccagctccccactcaggcccagcccccttttagagcccccagactccccacgcagggccctagccccctagtcttccccgtcaatgccctgttggcaatacagccatcaggttctatcagagtgagctgtttttatatgattattttcccccctgggaagacggctttgtctgtgaaagtccccccaaccaggcgccttataaacgcctaaaacagacagagttgaggagaacaggaggggaaaggaggagggagcaaacccggaggggggccctgaggttcgcagcgggcaggatgggggtatgaggccggagtcggcggctcccaggcccccagccccgtcagggcgcccccgtccccaggcgccagagccggggtccgcagccccctagcactccctggacggccgcgggcctccc

SEQ ID NO: 340251 - DNA, 264 bp, Homo sapiens
ctttgcgaacgcagaaatcaaagctactccccgcacccatactggggacccagatttgaagacgcccctcttttaaaaacccagaaacggcacccctcccggacccttcctcttcgacagcccaggaatctagacctccgagccccctcttccagcgaggatccaggaacccagaatgctcaaatatttgaactaatgaatgaaaattaagtcagtatttcaaagatctggaacacacttttagcatagagaaaactgaagtac

SEQ ID NO: 340252 - DNA, 224 bp, Homo sapiens
aggacccatgtctgtcttacttaccaatgaatcccccattcccagcatggtgccagacacatagtagatgctagatgacatggtttggctgtgttgccatccaaatctcaccttgaattgtaataatcccgacgtcaagggtggagccagggggagataactgaatcatggcggaggtggttttccccatactgttctcgtggtaatgaataagtctcacgaga

SEQ ID NO: 340253 - DNA, 221 bp, Homo sapiens
cagaaatttgaatcatgtggggaaagcatccactgtaagtttagtaacagtttggcaaagcctgaaaattatgtgtaaaatagtgctttaggagttctagaaactgaataacagactcattttctggtatcttgactttcagaaggcaaatgaatcattcttaaaacagtttagtttaaaaacaaatgtcaacaagcatttgttgagtgtccgccatgaag

SEQ ID NO: 340254 - DNA, 340 bp, Homo sapiens
gtttgagattatgcagtgatttcatttgttgccaagtcaatattattatggcgtggaatgggtgctaaaagccttctcaaattattaggaagtttgaaggcagaacaggtaagaaggaaaaacaagaatggagaaatgagaggatgaggaagggaaggatgtacagagccttgtctctatatctccttaagactgttttggcaatggcaagccctagcatagtcaggccccttgccaccagcggtgtgtgtagctgtgaacaacaatcactagggaatttctgccaaaccccacttttctgtattcagatgggctcagtaatatactcattcaacaaatc

SEQ ID NO: 340255 - DNA, 245 bp, Homo sapiens
agaatagtaagagaaactgggatggaaaggagaaagataaaatttaccaaacagaaacaaagagttaaaaggatctgacagaaaataataaagacagtggagaagatccaagccctctgagtcccagaagaaaaacaaagcactggaaaagaaatgctatcaactacagctcaaaactttcctgaagtgaatgaagagttcggcccacatattgaaaggacacaccacacacctgggaaaactga

SEQ ID NO: 340256 - DNA, 100 bp, Homo sapiens
taaggtagaacaatgtgtatgaactaataaggcaagagtccagcaggacttgttttctggtcacaacactgctgaacaaagtaggatctgttccagatgg

SEQ ID NO: 340257 - DNA, 157 bp, Homo sapiens
ttatcagaatagagagttagttgaattctttggatccatttgagtgatgaagcatgggttccaatttgaatagtgcataattaattgcatgatgattggagatacaatttagtatcataaataagttacttttgttaacttgttcaacaattacttc

SEQ ID NO: 340258 - DNA, 968 bp, Homo sapiens
gttttaattggcttttaaggggatagtgattatgcttttcttggtaaaataccaacatgaatagtcttgacctgtttgtaatagccaagcttcagtttagtttccaatgtgttccttcatgtgcaatgctcctcacatgactatttgtaagtaatttctgctggagggagttgataatagaaaccttgtttttggttttggatgttgggtgaacacagagaaaacacactgaggttggtcaagttcatgagaaagggcacatgagcccagattctcttcagtaacaaagtcctcttctttgagggctgagacctgttattttctcaagtgagcccagctttgctcatgctcacatttgattttccccatgcactccagcacgatagcgcttcttgtctctttgttaaagggttatataattatgcagatcaacgttgtgggtctttttccccttggacagtactttctggaactgctagatttccagatgagagctgtttattctggatcagacttaatttggtcagctgaattctcttgggtatgaagagtttttcttacccttggcctagtttttgtggttctaaatatctttttacagtttcaacaagtactctgtaaaacaggaatagttgaaagcactgctttcttttgccttcttagttcctgtgctgtttaatgatctcagtatgtcagttacattgccttctttgaaagccataacaactgagccctgcattgcaaaggaatgctttgttattctcaccatattcatcgagtgcccactacatgccaggctcctctcagcttgttacaaaaccagatggttaccccagtgcattcaggaaggtgatggagatatattcagggcccagtgggaaaaaaaaaggcactggtctagctgagatggcccaggaagctccgcgctgcttttacccacacacagcatcttctctaccttttattgc

SEQ ID NO: 340259 - DNA, 301 bp, Homo sapiens
cttagaggatcagaattcattagtgttgattggatgatctgtgcagcaaaccaccatggcacacatttacctatgtaacaaacctgcacatcccgcatatgtaccccagaagttaaaataacagttgaggggggaaaagaaagaattgattaggtgttcagaatacatcattgaacaaaacacaaaattctcctggggagaggcaaataagctgtaaagagaataattagctaaattatgcaatatttattattttttattatttattttttggtgttttttgggagatggcaccccactc

SEQ ID NO: 340260 - DNA, 331 bp, Homo sapiens
gttaacaacttgcccaaagtcacactgctacttcaagtatgtacaaaatgttatgagaacatggagaaagggttcctcacctagaggaggcaaagatattttcccagagaaaatgaactttcaatttcatctttgaaattatcttccttgtaaaaaggccccagtcagagagaacaaaatatgccaaggcagaaaaaaataatatgactctcttcagaaatcaagcagttcaatatcagtggggcacagagatgcaaaagataaaactggagaagtcaaaggagttagatcaatttggtctaacctgcatagcctatgaggggatttttct

SEQ ID NO: 340261 - DNA, 461 bp, Homo sapiens
gatgaaacaataagatctacctttttgaaaatagccctgaagcagctgtaggcggggaccgaggcgctggacctcacaaccctgcagagaccaccttaagtttctctgccatcgctgtgtggcccgtgtgtgctattaatattacctcctagagatgacctccaggcattttgcattttgtttccaagtggagactgagcaactggcctgattttctgctttgtcgtatagattctgattttgtctcatggatttttttgaagtctgatcacatcattatttgactttctcaaatacatgtgcggcaggagggacgtcagataatttttccgagggcctgtgcctgctctctcagtcaaacattctttctttgcaaccaactgatttgcatggcgatgacatttgttgctccagtaatttcatctgataatggccgggcttgcaaagcggatctgaaaaca

SEQ ID NO: 340262 - DNA, 311 bp, Homo sapiens
aagtataagtggacccgcatagttcaaacccatgttgttcaagggtcgactgtatagatggggagattaaataccccgtttgctaactctcagttgttaggtaacttgatggttcttttaaaccaaggtatctgtactcatatatacatatgtacataaaatatttgaagcagtcagatgagtattcaatctaaaaaaaacctttgtccatgttttcttaaactttgtatttgagtattgtcactgatatctatttgataagtttgtatacatttgagcaaagggtttttttttttttctttgagacagag

SEQ ID NO: 340263 - DNA, 643 bp, Homo sapiens
taattttccacaggtatactagggcaacaccacaaagattaatcctaacccactgtaaaaataattcactttgtgtgcttgaattactcatgagaagatctctgtctttgaaaactaacgtaattgtttagcactgcaattactgttcagaaatacaaatacaaagattcaaacagaatggaatgctaactaaagagcatacaatttatgagtcagaattaaaatgaatgtactgaatgattaaaaataatatttgagacaataacaagttcttaaaacattcaaacattttagtttactattttggagactacataattgggctgatcctatttatcctctatctgatcagcgtagggatacaattttcaatctgcacagtaattctgaaagtgtgttgtttcatttagactttatcttgttttctggctacattagtaacatccacacacggttctgaaaatatccagaccaagcaccttcaagaatctatttttcttaatcccagaagaaaaatgttttatgatgaagaagaatcagctcattaaggaaaacttctactatctacccgactatctctttctttgctctctcactttgattaattccgtcattaccacatcactcctgcccctgtactgtg

SEQ ID NO: 340264 - DNA, 173 bp, Homo sapiens
caaaaaagatagaaatttaaccagtttctaatttgaccaatgaaaaactttacattaacatgactgcaataaataattatctggtaaacgttaactgaatgctttcattttcatctaacttctagtcactcaagaactaaacagtactgatactcaattggcacatacccaag

SEQ ID NO: 340265 - DNA, 223 bp, Homo sapiens
tgtacttcgttttcctgcccatttctccccagagttctgaagggtcaacaacaacagctggaacgaaggtggaggccaagtgaggatgggagatggcccattatcatgtccagccatgctgggggacgaacactagagggtacacagaggacaaaagctgacgcccaaagccattatgatttttctcttctaaactattttgctccagaaatcagccttttat

SEQ ID NO: 340266 - DNA, 393 bp, Homo sapiens
ctgaggtcaggagttcgagaccagccccaccaacatgttgaaaccctatctctactaaaaatacaaaaaattagctgggcgtggtggcaggtgcctgtaatcccagctactcagaaggctgaggcaggagaatcgcctgaacccgggagacagcggttgcagtgagccgagatcgtgccactacactccagcctgggcgacagagcgagactccatctcaaaaaacaaaacaaaacaaaaacaaaaacaaaatgtgctctgctacgacggatgggattcctttaagcatctttcccctaaagcattctcactagagggcgcaaaggggacactgcagggtgaaggggctctccaaatgcttctgtgggtcaatggtggtgttggggaggcaga

SEQ ID NO: 340267 - DNA, 601 bp, Homo sapiens
cgacacggtttgtaggtcaggacattatgcccattgaccagatggaagactgaggctcagaaacaaaacacgagttgttcagaattccatgcccagttaatagtaaatgcatggactcatcctaagtgttctgacttcaaatgcagcatttattctgccataataggagtcatttggccaggaaaaagaatggctaaaaataagcctctggaccttcagtttgctgcttttcctcttggattcattatttctcgttgttttcttgcttttccccttcattcaagcacaactctagctaccaaggagcttcaatgacaattcctccagctgatggatttggccaagagtcagagagtctagcaacaacctatgcattgacagtttatttttgtgatgactcaattttacttctgattgaaaagcaaaatcctcttatcttctagatatgggagaaagtgacataggttctaaccaatctagactacagcccttctttttctttcaatgcttatattctctttcctcctatataatgaccatttctagcaacaggctaatttaaggtgtggagagaaatattcttctagtcaaaaactgtttt

SEQ ID NO: 340268 - DNA, 393 bp, Homo sapiens
tatcaattccaggccctacacaccacagggcctttgcaagtgccatttgctgtctctggaaaacacacacatctctcctcttttgcctctctctctacctcctactcaaacctcagctctcatctcagatgtcactttcttacatagaccagtctgtctaggtcagggttttgttgttgttgttctagtctctcaattccctttctttctacacgcttaactcactttgtaatgaaaagattattacttgatcagtttgggtgtgccttccccagaagtctctaagctctatggaagctgagctgtctactttcacatatcattgtatccccaacacatagcacaatgctcagctcagaacaggcactcaaatctgtgaaaaggaggagagag

SEQ ID NO: 340269 - DNA, 506 bp, Homo sapiens
gcaggagaattgcatgaactcgggaggcggaggttgcagtgagccaagattgcgccattgcactccagcccgggtgacaaagtgagactctgtctctcacacacacgcacacacacatgaattagtctctaggcagaaactttgctttattgattggttttcttcctcctcttgaggattatggaggaaaagaggaagccttttaaatgaggacagcttggtgtgggtaagtctcaaaatataagtggagtaactggaaaagcatgccatttagtatgcatttgtaccacacgggcattgttgctttgtgttttaggttctcatctgtaaaaggtcagcaatactatatctcctgtccctcctgttttgtcccacaataatagccggcttttgtgtagtttagtttacaatattttgtctggattgtcttggggcctttggggctagttttgaactttgatccacaggagtaaatacaacttacagtgtgtcccaataccaccttg

SEQ ID NO: 340270 - DNA, 166 bp, Homo sapiens
tgcacacagaatggaaaggactactggtccccgtcctaaactgccacatctgtggttacacgtgtgaccattgcatcaattacatggcatgtaaataacaagtgagcatggttgtggcatgggaaataggcttgagggggttacttgcattcaggaaccaggagta

SEQ ID NO: 340271 - DNA, 183 bp, Homo sapiens
agtgaattctgctccctggagagcaaggatgccaggatgagaggcttggggagttttgagcaggaacagagggaaaatatcagtctagcctgatgctcttgtggctgtgattcatgctttttttttttttttgtaactaacaggggttattgtggattgagtctgtggaaacggaatggaatg

SEQ ID NO: 340272 - DNA, 610 bp, Homo sapiens
tactcccaaggttcagcagcatctgctcacctagcaggctttctgctcttttctgggatgttggtgctgtagtgtggcccagagctcttcaccaaacacagtgcatgcattaccttttttaaaaataaaacttttatattgtaactactacatttgtaaaggttaattattttgtttttcttggtctcagcaggtttaattgttaaacttcgggaaacaattcagagtggcccattgaactggctgctgctcaggagtaaactgagacctgccctttaataaatagaaaaccaaatgattagcagcagaattagctcatactcactactaactacctgctctctgtatggcactcagtagctccaaccacttaacatttttaagccttttttcccctctgtaatgtaaacttcgtgaagctcaggcctttttaaaatgtatacccttcgctaagtacgcttgatacaataaaatctttgttctctgcagcattgcagattcatatatgtatatacacacatgcactgtctaatatttatctggtctggaataagcattaatctttaattactatataaacattttaaacaggtgtggaataactgcactc

SEQ ID NO: 340273 - DNA, 420 bp, Homo sapiens
agttgctgcatcctagcccacaaaagaagaaatgataaaatcattttacattgtccattggcagacatacagagtggaggcaggaagacaggattgcttgctgattttgaaaagtgttctgaacatttgatttggggttctgtctcataggaatcactggaggaaacggtgggagttgtgtttgataaatcacttaaaaaataaattctgttgtgtatatttaaggtatacaacatgattttataagatacatggatagtaaaaaaatgtatagcgtgttcacagatttgcatgtcattcttgcacatggacatgctgatcttctctgtattgttccaattttagaatatgtgttgccaaagcaagcactaaatcatttttacttatttattctcctactaactagtaggaaagaagact

SEQ ID NO: 340274 - DNA, 118 bp, Homo sapiens
cgtgtctaacacaacacgaacgagtccaccgtgtctaacacgaacgagtccaccgcgtctaacacgaacgagtccaccgtgtctaacacaacacgaacgagtccaccgtgtctaacac

SEQ ID NO: 340275 - DNA, 793 bp, Homo sapiens
acctcctgggctcaagtaatcctcccacctcagcctccccaaagtgttggtattacaggcatgagccactgagcctggcccacatagagttgtaaatcatgaaactgttctggacagaaagcagatggcagaatcacaatcttctgtgtccagagattatttgagattattttaagaacctaagtacaccttttagagcagggatttcttggatttgaatttttaggttacaatttgctttttagttgtattgcctgcaaaaaatcttaaatctctttgctgtttgtgacattgtgcatacttctcaatgatcttccctcttcatactttaacttactcctctccttgcccagatcactaaagcggcatgactcagccagcagaattgtcatcatccccaggccttgagcagctagtttgaaaaactgaaatagatctggcctcattgaatgctgttttaggtgaaggaaggtaattttgctctggcaggttggcgaattagtatgttacagctgtaaatgtatttctcctaaggtggttttctagcatcgtgtgcctcaattcagttgtttctttaaagttcagcattgcttttttttttcacctattcattcttggttaattaggaaaagacagcatctgttgtgggttttgttgtctggtgtagatgactgtttaatcagagaaggcattatgtcttgcagttagcagtttgaccctttgcagcacaggcttggggcgtgacctcaggatgtgactgcaccaaaccttactattttatagaaaatgggga

SEQ ID NO: 340276 - DNA, 263 bp, Homo sapiens
attatcttcagttctataaaatacaatgccatagcagctgctaggcaggctagaaaaaatggcagctagccccttttgccaagctcctgtccctaaatagtcagcacaacaacaacctgtaggcctagccctttaaaaatgttaatattcacagagggaactaatttccacctcatcaccaccaccaccttccccttagagccagatttctcggctcagcacttcattgatcactggtgaaaagggataatgtgatagcagct

SEQ ID NO: 340277 - DNA, 273 bp, Homo sapiens
aggatgccacagggaggggggatggacttggactcacagggcgctcatccccccagcctggctggaaggcgtgtggcacagatggcccccgacaccgtgcctcctgcccagctcagcagagggcactgctccgcgtccctttgtcctgccccagccggaggctcccagcctctccagctgggcttatcctggcaccgattctaggacgcagctgagccttactcgcaggcttgggtgctaggatccaagggaggtcacagaatggggcaggtc

SEQ ID NO: 340278 - DNA, 807 bp, Homo sapiens
ccgtcgaagcttttatatttttgtccctcaatgatatattgtttttctcccttaccatagcagtgggagagataataaaataataaataaatattgattgaagtgagaaaactggggaaacattgctgcgaaggaaggttttttctatcagtgtggtgtcacttaagcataagcataactgcagacattgattggtaaggaactgttacatttaaaaaggtattttagtggaattaaaattttttttctttgtaaaaaccgagggaaaattaatgtttggatttagagtaagttcaaaagcatatttatattacgtttacaaatctggtaagattattgtatttacctttaatattcctcgaacttattggccattaatacatcctgtctaaactcattgtcaatagaaccccagaattatgtatatgacgggtcagtattagactcagaaacaactgtattcagtaaaatcttgtaagaatcctcttagatcaaagttaatgctgtcccagtttagactgagggcatagtttctccagcacctatttcatttcctttccaaccctattttaaaccttttttctttttttttaacctctatgctttatgcactctcagtctaaattttactaaaatgatacatagattgttctcctgtgtaagaatctttagtggcttatgataaaatatatataacataaaattgaccatttagccatttgtaagagtataattcattggcattaaggacagtcagccctctgtatccatggattgaaccaaatgtggatagaaaatatttggaga

SEQ ID NO: 340279 - DNA, 443 bp, Homo sapiens
  misc_feature (91)..(91): n is a, c, g, or t
tagtgacactgatgaagaggtgacatctcagaaagtctgaaacaggtcaaaatgtactgatgaatgtggctgcccattaaagcatggaatngaagaaatattagaagtaagtttaagggatactttggtgtttctggattcaaattaaataggagcatactgactacatgaaaccctgaagggaatagagatcacgatactctaagcccgtcattgtacagatgaagtcactgagccacagagaagctgagtggcctgcccagaatcaaatgttaattcatggcagatctgggagtaaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaaggg

SEQ ID NO: 340280 - DNA, 132 bp, Homo sapiens
gagaagaaagaggaagtaaaagtgaaattgtcatgatagaactatctagaaaaggaaaagaaaaaaaaaaatcaagggctggtaaagacaacagatgaccactagcaattgagcacctactgtcagacccta

SEQ ID NO: 340281 - DNA, 409 bp, Homo sapiens
aggattgattcctaaagactcatgttatgtgaagaagcagctcagaagaggaaaggaaaggagccaggcatggctcttcctcagggacgcttgactttcagggatgtggctatagaattctcattggcagagtggaaatgcctgaacccttcgcagagggctttgtacagggaagtgatgttggagaactacaggaacctggaagctgtggatatctcttccaaacgcatgatgaaggaggtcttgtcaacagggcaaggcaatacagaagtgatccacacagggacattgcaaagatatcaaagttatcacattggagatttttgcttccaggaaattgagaaagaaattcatgatattgagtttcagtgtcaagaagatgaaagaaatggccatgaagcacccatga

SEQ ID NO: 340282 - DNA, 399 bp, Homo sapiens
caagcagagtttccccaatatgtctttcagatgaatgtcagggcatcacagcaggccttttgaagctaggtaacgtggggcattgctggctgaggtaagtgctgacacaggcctaaaccacagcccgcagcatcgtactgtcacagaggcttatttcaatgatgatgtgcccctacacatcttcccgccatgatttcttttccatgtattcagatgagaaatgattccgttttcaccactcccagataggccgggttttcccattttataaaagtatatgctgaaccctgtgagtgttgagggattgcagggagccaggtatttatcgctgtgttccccacttctgtgctgccgctccgatttctagagatgtgcagttgagaaacagtagttttctgc

SEQ ID NO: 340283 - DNA, 367 bp, Homo sapiens
gcagtaatttacagtaaactagagagtattcactcttaagaggctggctagatatatgagaaaaacacaagcaagcataggtagagatcatgtaaattagggaaattaaacaaaaattttccagatgtataggtaactaatcacatatgtaagcatcttcaccttcagcagcagcagcagcttaaaataaaaaaaaaaaattttttttggtatttcaggctgggcgtggtcgctcatgcctataatcccagcattttgagaggccaaggtgagaggacagcttaggcccacgagttcaagaccagactggacaacatggcaagactccgtctctacaaaaaaatttaaaaattagccaggtgtgatg

SEQ ID NO: 340284 - DNA, 313 bp, Homo sapiens
gcaaagggctttctgggtgctggtatgatgatccctacagcagagggtataatgggctctggtacctaattctgtgtgaccatggctaaatcacctagcctctttgagcctctgttttctcttctctaaaatgggattaataacagtactgatcttatatccttgttctatgaaagtatcttgtattaagtgttgcatgaaaatatcttgtatagccctggcacatacaaagtgctcagtaaatggtacgtatatttttatcattaacattatgttcctagccaccccttgcatggactctgttaacaaccaa

SEQ ID NO: 340285 - DNA, 414 bp, Homo sapiens
ccagagtttggttattttaactgaagacctcaggatggacaggaaccaagacagtggtggggatcttaaatatagaaacaagtagatagtttcatcaagactcagccattcgattttcttagctctaacatttttcaattccttgtgtcaccctactcaggacgcaagttcctgggagaaggaatttgattggcttatatgcctgtgctttggaaagaatagagaatactttgaccgacagctccaagactgcatgagataaggaaagaggagttcttcagagtattttttttgttggtttgttttttagcctaaggaagttaggtagtgatgcaaaataggcagaaacaaccactggccaaaaccagggtgtatttcactgatgaacagtactgtagaatatgtggaatagtt

SEQ ID NO: 340286 - DNA, 707 bp, Homo sapiens
gggcaagagtgaaaagcagagacatcagttagggggcttgtgcagtagttttaagtaattgcagcttgaaccagggcagtaggagtggagatgtagagaagtagatggaattaggatatgttttgagaggtacagttggctgtaccacttgctgtgtcacctcaggcaagttactcagtatgtgccttttggtcctctgctgtaaaatgagaatactagtatgaaagtactaacttattggtatatgggttttgaaataatattaacagtgcttggcaatgtggtaccactctccctccattgttcttgcttagaaagcctcaaatgtgattaaattcaactcagtgtttgtacttgcacctgagtggccagagatgcaccttgtagccacattgacttgtcttgcttaaatttatgaacattaaggaacttaagttcatgagcactaaggaacattaaggcacactaaggaaccttaattgggtccttagtatgcagcacctgacagtcttacagtttactagtccagtcactcttccactgccacaggatgctttcatatcatctagcctgcttattttcacttgatgaccctagtctttatttgattgagaatttggaaataatcgagacagaatgtctacaaggtcctaccgtagctacctacctgctagcctcttcttactgtagatagttctgaattgtgg

SEQ ID NO: 340287 - DNA, 610 bp, Homo sapiens
ctgagctgggcccctacggctgctcaacagtttcatttacaggaagactctgttcagctcctttcccacacccttcaaggagtgtgggaaacctccaacactccacaactctcttccatcccaacaccacccccagtgccatttctcatccatgtatcaggcacaaactcctgccaccttccacctttccactgccccagctggtccctcctgtccctctgcttgcctagggctaagcctccctgtgtgccctcctgtctctactaatcccctatgtctactctcttcatcctctctacctccagagacggctcctcccagcttgtaaacatgtgcaagtctcttccatcttaaaaaataaagccaaaccctcaaaaaagcctgagggtcccctagacctaccatcctttcactttattccctttcacataaagctgggacctcatgaaggaatagtctgtactcagtgcttcagtttcttcaaccacaattcacttctcaacatgcctccacctggatcccctcaccaccatctcctctacacagccacactcagtcctgagccatactggaatctgaggcaaaagggacaatcagcaatactgacgct

SEQ ID NO: 340288 - DNA, 222 bp, Homo sapiens
agactaaaggaaatcctcgtttacaccaacgtgagcattgtgatagtatcagtctgcccacatcctgaaaatattaagtatttaccaaaaaattctcttctaatttgattggggaaagtgttgttatagcagtttaatttgggtagactttaaaagagtcaatcatagattctttgcatgtttttaaacatgtttcacacagtttaggacaggttgaggaca

SEQ ID NO: 340289 - DNA, 235 bp, Homo sapiens
ggtctgggaatgggggtacaaggactgactacaaagggcatgaaagaatggtgaggctgataggaatgttctacagcttgatcacagtgctcattacataactgtatcaaaactcatagaattgtaaattataaagggtaaattttataaacttatcaaaactcatagaattgtaaattataaagggtaaattttactgcactttatactacaaattatacctcaatacacttga

SEQ ID NO: 340290 - DNA, 1099 bp, Homo sapiens
tgggcagctgcagtccagtgtgtcctaggcatgtgctgtgtgctggggtctttggcagtaggggaaggggttatccctgtcagagagaggagaaggggcttcctggcagagggaacacacagtaaggcattaaaatgtgacagtgtgaaagcatggccagacaggcgcttgagggacggagggagtggtgggaaagtgatagcagggtactttgggggcagatcctgaagggccggccctcagccccatgctggagagtttgaactttagttgatcattggtggagaatcataggtttttacacagagccaggatcggttgagaaagagacagttcacctgttcatctcctgttctccatgcctaagggtacggcaccgtgctggctgagggcagggcctcaacaggtgatggttaaagatggcattatggggctagggaggcctgtgagcagcggtgcagcagccctggcctgatgatgaagggctgaactaaggcagtagcaggaggggtcaaggaaagctcccggaagcaggattcacagcactgagttgatgaggggaggccagagacactagtggcactgtggcgagtgggcctccgagtgctgctctgagtcccgccccagtgctgcggatgaagagcgcgtgccttgctttggcactcgcctgcttggccttgtcttgagccactgccccattctccacatcttcttcagtgtgtttgtcatgttctcacgtaccgcggggtcctccatcatctctccagcagccgccgcctctggtgttctgaaggatgcaccttctgctttgcttcctagctccccttcctgggttgtagtcatgggtctgtgtgattggttattgagggtctgagtctcaggacactggaaggggtgggagcctgccaggactaggccccacggtgttctcagcatggacgataggctcggcaagtagcggccgagtgaaagcctagttaaacgaggaaaacaggctgggtgtggtggctcacgcctgtaatcccaacactttgggaggcggaggcaggtggatcacctgtggtcaggagtttgaggccagcctggccaacatggcaaa

SEQ ID NO: 340291 - DNA, 220 bp, Homo sapiens
acccagctaatttttgcatttgtagtaaagatggggtttcaccatgttggccaggttggtctggaactcctgacctcaagtgatctgcccgcctcggcctcccaaaatgctaggattacaggcgtgagccacggcacccggccagtgacttttaacttcactgatgaattcaaaatctcttacagagctctcttacgctctgtgcgtagctatcatcacg

SEQ ID NO: 340292 - DNA, 214 bp, Homo sapiens
tctacaatgataaatatcaatgaataaataaacaaattggggagaaagaaaagatagctcttacagaaaaattctaatcaatatagaaggaattatggagttagaagatcattaatagatactaaaataccaggtgaaagtctgataaagaacaagatatttacatggtctcaaagtatctccctacaaattacttattaattacaaagggaaa

SEQ ID NO: 340293 - DNA, 206 bp, Homo sapiens
aacatccatttctttcttgtttttggtcccttgggttcttcattaaaaagtgtgtttttttgcctaagctgataggtttgtatttgcaaccaaagagccttgataaaatagtgatttacaatttactaagcacttgcaggtacaataatctcattcgggactcacagtaccctatggaaatgaagagaccagtttcttttaccttg

SEQ ID NO: 340294 - DNA, 607 bp, Homo sapiens
actccagcctgggtgacagagcaagatactgtctcaaaaaaaaaataaataaataaataactcagagccataatttttgggaaacatggttattggcatcagaaagccacactaggaatgcagatccctgttcccattgctattggtgacctgggaaatggaattgataagaaaggaagcaaaaaaattttttttcgttaagcacttcactggttgccgccagttttgtattagaatccagagtttgaaaaagttgattctgtcagattttgccagcttaatggatgcttcagtggagggactggactgattattggaactccctactccatcatttatgtggcatcacctaactgcttttgcttgccttagaacttccagcacagatacgaaaaaaaatggtgagagaagacatccttgccttgttcttacatggaagacattgagtctttcactgttaggtatgttagctatagttatttttaagaaaatctttatcaagtttaggaaatttcccactattgctagttttttgagagttcttatgaatgctatgaattttgtcaaatgattttctgtatttattagtatagtcatgatcatatga

SEQ ID NO: 340295 - DNA, 370 bp, Homo sapiens
cctgcgtcgactgaaaagaaaaccactttcacaattcccatctctttcctggctgtacgtaccccgcatatcctagaacgatatcacaacaacatgttcatatatggctgaaacctggttcaactagatgtccaaaatcaatggagtgcacattatcctacaagtgcagtttgggtggcatgaggggacagaggaggtggcagactcattgtctttctttgctttagcaatagtggcagtgctttttgatttgtatggccagagccttttcttacagcatctgccgtggggagtcacctctctcttgcaagaaagtgctacgatgaagcagagaatgagatataagtcccatggagaaagtactttatgc

SEQ ID NO: 340296 - DNA, 102 bp, Homo sapiens
gaagtgaggggataggaaggatgaaaaatgactcctagattgttggcttgaacatctgggtggtgtcatttactaagataaggaagtctaggagaagaacag

SEQ ID NO: 340297 - DNA, 347 bp, Homo sapiens
agagagaagaaaaaaataggaccctgagtataggcaactttttcagagttttgctatatagtagagattcgtgtgcagtaatcagaggggaagtagagtcaagcgttgtttttaagagttaagaatactgattttgtttgctgctgcttggccttccaagaagaacttagtcctgacaaatgatttaattctttactaatgagaatttaagttatagtggtgacctcaagagaggtcaaaaattgttctaagaaatcagtacacaaatatccaatttcagttgacctcacaggatgcttaaggatcatccacattataacatttctaacagtcttattcttttccaa

SEQ ID NO: 340298 - DNA, 280 bp, Homo sapiens
caaagaagacagtagtttttcagggaccgttaaacacaatcttcagcaaacaaatccagagcagccctcttcccatgagaatatattggtagagttttagggagagatgaggaatttggaatttctggaaattattgcagaggcctacaggatatgatctaggtcagtggtagttgaaactttttttttttttttaaaagaaggaaaccattggaaaaaaaaatcttgctggttccctggtctctgagggcagttccagacctttcttggtcttcctgtg

SEQ ID NO: 340299 - DNA, 634 bp, Homo sapiens
cttgcccccaaggttaatctttattaccaggaagaatatgtgtcccttccccagggaagacctggagtagtccccaaaaaaactgagctgacaagtggttgtagatatttaagtcatctcttggcaccatgtgcccaggaaaggtatcccactaggcttggaccttcgagtggggatcttttccctatctactgggatccttccatactgtctggaactgtcaggatttatgctaacaattcctggaagaaggaaaggctacacttccactgtatagggttaaaactgcagggaggcgggtaatgtactttcacttgaagatgtaattaatattggctggctttatagatatcatcctcaagctcagatggaactcaaaacaatatgctgagatattatgaatccaggactcgacttcgtaagtattttgagttgaatagatttgtgtatgaaaaaggttcataatttttttcaattctacagtattaacatctaacttataaaagaatactggagaactggacacagtggctcatgtctataatcccagcagctcaggaggctaaggtgggaggatggtttgaggctaggagttcaaggccagcctgggcaacatagcaagatcctgtctcta

SEQ ID NO: 340300 - DNA, 427 bp, Homo sapiens
attacagttatgagccaccatccctggccaataaaggtgtttttaatacctataagaatattgcctgcaaggatgtttgataggtttcttgatatttcattctctcttgaaatgtttgcttcgtcaattttttatttttcataaaagctttactcaagaattaggatgaccactatgttatctagtagtataatttggaatcatttattataaatctgaaactgacttgactgatgaatcttgagcactgcttattgtgttctaattttggtagctgtttcaataaagtagctcttgtagaataggaaaactatatcattttagtctgaaataagcttttgattaaaaggttactttttcctattaataaaaaatggagattaagattgcttttcttgctacacaaaattatttacatactttcctg

SEQ ID NO: 340301 - DNA, 207 bp, Homo sapiens
catctaccagtagattaaaattttatgctttgatttacattttttaaaagttagtatttttaatggatatgattttttgatgctgagctgactcagaggaagaacttcaaaacagaaacattaaatgtctcagtgaactgaacaccaaaataccaaaataaagtcatgagattaaatgcttaaggggtgggaccttcagacattttt

SEQ ID NO: 340302 - DNA, 483 bp, Homo sapiens
cccaccctaatccaggatgacctcgtcttaaccagttacttcttcaaaaacgctatatccaaataaggtcacattctgaggttctatgtggacatgaactttggggaacactacacaacccagttcagaccatacagacgtgggagccgttcccctatctaccactttgtagccgtgtgacttcaggcaagtcacatcaccgctttgtgcctctgcttttccacctgtaaaacagaaataacagtcatcatcaccatcatcatcatcatcatcatcatcatcatcgtaatccctgctaggaatgctgccgggcacatagtgatagctatgcagtttggtcagataaagtcagccaagtgcccgtagctgctatgtagaggtaaactgcatggacagccatgtcatcaagggccccactgggggtgacacagaagggaacagactcatagggccaaccagaatgcacagggcagggcgcctacc

SEQ ID NO: 340303 - DNA, 156 bp, Homo sapiens
tgctggctagggattctaaaattatgggaaaactggaaaattgatattagggcaccatctgcccctttggccatgccctctctacttcctgtatacaaaactcactcaccttatccttaagggagaccactgtaaaagttctaactagttgcagca

SEQ ID NO: 340304 - DNA, 1257 bp, Homo sapiens
ggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctgga

SEQ ID NO: 340305 - DNA, 1233 bp, Homo sapiens
ggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctgga

SEQ ID NO: 340306 - DNA, 946 bp, Homo sapiens
  misc_feature (559)..(559): n is a, c, g, or t
gggcctcagcctccggagcagctgggattacaggcgcccgccatcacgcccaggttctccttctctcctctatcctgccactttgtgaagaaggtgcttgcttctccttcaccttccaccatgattgtaagtttcctgaggcctccccagccatgtggaactaggtgacatttttccaacgcctgaatgaatgatgagaaggagccaaacatgaaattctctggggaaacagcattttcttgagcgggaagaatacgttcaaacttctgtggcaaaggagataaggtcaaaatgaaaaatagaatataaaaacttctctactcctgactcaccaacgcaccagaacaacttttagtcctgcaatcatgaagcattgatgtgaacatcttctacatattatcaccaccctagacactacaacaacaaagaagtcaatactagtttcaatttgtggaaagctggaaatgcgatgattcccatgccctgagtttctgctccagacaccaggtgggggcatggcaattgtgactggagagagtggaggggtcatcttatccancacatcagaagctgaggttaggatatgtgtggcagagatgaaaagtgaagtgatgtgaggaaacttcatcctgaattcaataaagccctggaatacttgttcaaataaccagctgacaacttgggggtaaagctgtctgtgaattaacctgtttagctcagccaatacaattatgaaataaaacagttaacagtctactattttgtagtccctggataaagaggcctaaatggtatcctgtaaagttatgcagagtactatctgcatagatctagtcaatgaccttggctagtagcatcattggtttccactttatgtgcatcaattcttctttatatgcagtagttaattacatgcccatatatcttatctcttaactcctgggga

SEQ ID NO: 340307 - DNA, 778 bp, Homo sapiens
  misc_feature (391)..(391): n is a, c, g, or t
gggcctcagcctccggagcagctgggattacaggcgcccgccatcacgcccaggttctccttctctcctctatcctgccactttgtgaagaaggtgcttgcttctccttcaccttccaccatgattaaaaatagaatataaaaacttctctactcctgactcaccaacgcaccagaacaacttttagtcctgcaatcatgaagcattgatgtgaacatcttctacatattatcaccaccctagacactacaacaacaaagaagtcaatactagtttcaatttgtggaaagctggaaatgcgatgattcccatgccctgagtttctgctccagacaccaggtgggggcatggcaattgtgactggagagagtggaggggtcatcttatccancacatcagaagctgaggttaggatatgtgtggcagagatgaaaagtgaagtgatgtgaggaaacttcatcctgaattcaataaagccctggaatacttgttcaaataaccagctgacaacttgggggtaaagctgtctgtgaattaacctgtttagctcagccaatacaattatgaaataaaacagttaacagtctactattttgtagtccctggataaagaggcctaaatggtatcctgtaaagttatgcagagtactatctgcatagatctagtcaatgaccttggctagtagcatcattggtttccactttatgtgcatcaattcttctttatatgcagtagttaattacatgcccatatatcttatctcttaactcctgggga

SEQ ID NO: 340308 - DNA, 881 bp, Homo sapiens
gggcctcagcctccggagcagctgggattacaggcgcccgccatcacgcccaggttctccttctctcctctatcctgccactttgtgaagaaggtgcttgcttctccttcaccttccaccatgattgtaagtttcctgaggcctccccagccatgtggaactaggtgacatttttccaacgcctgaatgaatgatgagaaggagccaaacatgaaattctctggggaaacagcattttcttgagcgggaagaatacgttcaaacttctgtggcaaaggagataaggtcaaaatgaaaaatagaatataaaaacttctctactcctgactcaccaacgcaccagaacaacttttagtcctgcaatcatgaccatccttccttctctaatattctgaccacatgtatcagtattcagaaaaaagcaagagcttcttctcgcaggcgggattgccattgaagaggatgtcaagaaagatgagtcactgttaggattgattcatgatactttattgccaagctgcatttgctgatagagtcatctatatcctggtatccatggaacacagtggaagggaaatctgtccttgtcattacctggccacaggcctcttttaaaagatactagaaaattaattagactgcaaattcacccataaaattaaagtaaaagctacctgggctcagggctctgaaagaggataacttatttggattagaaaatttgtcatgttgagctcaagtagcattaatttgtttagaagagataatgatatttcattattattcccaaccctgaagttagtcaagaaataactaaaataaataccttgtaaatactgactacacataatacttatactctatagcaacatggccacact

SEQ ID NO: 340309 - DNA, 656 bp, Homo sapiens
gaaggggacggtaaaatcatgccagatgtggcaggggtgaagacagtgggggattgggcagagccatggtagacatcccaccgccagggatcagagatgacagggcagcaggcgtgcgggggtggagcccacatgtagatcccccgcccccgcacacagggtcaaagttagctgggatcagggatgacgggggggtgagaagaagcgtggattttatgaagagtagaagaaacagatgtttgttaagacctaacatgtgggaggcactgctgtggacaggagtgagtgagacgcagggccggtcttcatggagtttacaagctggcgggggatacagccctgtggacagataactgtcattacacgggctaaacactagcatagggggaattctaggagatacagggacccacaggtatggcaccagactatggggtcagaataagatctcaccacagaggtatgagcaaaaagaaacaggatatggtctgttcctttcaagcttcccacaggggccaggagccccttttgcaggatgtcttaataaatgggacataaaggtacccatttgtctagagtgcagtgttggctgcagacagtgaacatatgaaatgatgcccttaaaatgccctttggctcaaaacgagtccccttcc

SEQ ID NO: 340310 - DNA, 434 bp, Homo sapiens
gggggcaaacacaggaggcgccggtccccgtgagccagacacaggagggacatgccacttcttccacgcagggactaactagcagcaatgctgcagagacacaggtcacttctcaacattcctggtcaagacagacctcttaaaatcatgggtaaatatccaccgactgcctcctagaagcccgcactgtgctgcacgctgctggggaatactgaggaggggatgtgaaatgtctgtatgtgacccaggacctaactgtggaatggagtccaattctcagggacagagaaagtgctccggtgtgtcctgctggtggagagcacaatcgtcattggagactggatgagctcagggcaggctgatggattattcaggagaggcttcataggggccaggggcctgagctgggctctccaggggtgcagcctgggcag

SEQ ID NO: 340311 - DNA, 378 bp, Homo sapiens
cacttctcaacattcctggtcaagacagacctcttaaaatcatgggtaaatatccaccgactgcctcctagaagcccgcactgtgctgcacgctgctggggaatactgaggaggggatgtgaaatgtctgtatgtgacccaggacctaactgtggaatggagtccaattctcagggacagagaaagtgctccggtgtgtcctgctggtggagagcacaatcgtcattggagactggatgagctcagggcaggctgatggattattcaggagaggcttcataggggccaggggcctgagctgggctctccaggggtgcagcctgggcaggggagaaagggagaactctaggaaggggacggtaaaatcatgccagatgt

SEQ ID NO: 340312 - DNA, 453 bp, Homo sapiens
ccctcccacaaccaggcaggtaggccctggccctagccctcctacaggcccagcacaggtcctggggtacccactggggctttagtggggactcagaacaggactgagggtgaggctgttagggttgcctgaggtctctccaccccactcagcctttcagatgagggccccgaggaggacaggtcacatggcagataggtgagtgcagaccccaggccagccctgcccgtgcctcgaccctctgccacaggtcagttctgtatggaagcctctagaagccgattccagcgtggtaccctctttgcccctggagagctgtgcaggtgcacgagctgtctgcaccggcagcagcctctcggctagaccagggccagtcacggcagccttcaaacctcagcgggctggaggcccatctacacagcctgtcgagcttggcctcctcatagaggccag

SEQ ID NO: 340313 - DNA, 1364 bp, Homo sapiens
atgtggtctgtaagagcctctaaggagaagacttcccttcatgctgttggtgacatgctttctgcttaccagaacagttcattctttcattctagaaacacttactacatatttttgtgagcacttaatgtgtacaagatacctgtcctaagtgctttaggtacggcttattttaatgaagccttagaataactcaaggaggtaagcatttttaggtgaaattctctttacaggtaaggaaactgaaagtttaagtaatctgcccaaggatctccatttaggaagtggcagagctagcacctgaatccaggaggactgacactagggctctgaagcacagtttttatgggtgccccaggagcaatcagagatttagtctgaaaagagagacacattgacacaaaggaacacagcaagtgataagaagtgatccccaggaatgagaaagggcagtgggtagtcttctagacagggagaggtggatttgaatagaaaagaaatgtgagcgggaaagcattccagcaataaaaacaggcatagaagggggaaagtacagggcatgttccagaaaaagcaagtactaaattttgacttgtataaaaggtcaatggggaaagaggtatttgggtcaataagaatccttaaatgctaggtgggaagtttccattttcatctgtggacagtgggagtctgaggatttgtgagtcagggagcagcgtgatgacatctgagctttgagaagctcttagagcatgtatgtaagattacatggaaggagacaccagagagaagaataccagcattgccatggtcgagaggaaagaaaacaatggccagggaataataaggtgatgacagtaggaagagagaagagagaccagatgtgatgatggtgtgggactagagagagaaaagcaagaaagtccttgaaaaggttgtttctgagcctggagattcaggcagtagcagtagggctggggaggatgaatgtggagagctctacctgtgaggtcctggtgggcagtcaggtgggtttgtttgttcacccctttgcccatttattctacagatttctgttgagtacctgctgagtgctggcttctgtgttctgcaaagaggttaggtctagagatgaaaatgtttctggccagccaagcattagcaagtagcacagatgtggaagtgatggaaaccagggatggtaaaggggaatggaaactttgagattacagtggaagagaacagcaagaaaaggagaggaggggtgaggtggattcctagagaccacccacctccagagaaggaggaaacagaagcaggaaaagaggggttagagggacgagggagtctggagagcgttgctg

SEQ ID NO: 340314 - DNA, 609 bp, Homo sapiens
atgtggtctgtaagagcctctaaggagaagacttcccttcatgctgttggtgacatgctttctgcttaccagaacagttcattctttcattctagaaacacttactacatatttttgtgagcacttaatgtgtacaagatacctgtcctaagtgctttaggtacggcttattttaatgaagccttagaataactcaaggaggtaagcatttttaggtgaaattctctttacaggtaaggaaactgaaagtttaagtaatctgcccaaggatctccatttaggaagtggcagagctagcacctgaatccaggaggactgacactagggctctgaagcacagtttttatgggtgccccaggagcaatcagagatttagtctgaaaagagagacacattgacacaaaggaacacagcaagtgataagaagtgatccccaggaatgagaaagggcagtgggtagtcttctagacagggagaggtggatttgaatagaaaagaaatgtgagcgggaaagcattccagcaataaaaacaggcatttaggtaacagccatttaggtaacagccatttaggtaacagccatttaggtaacagccatttgggtaacag

SEQ ID NO: 340315 - DNA, 584 bp, Homo sapiens
aaacatgctatgattaaagagtattacgctttgctctttctgtagtccccaagaaagcctatttggtcctccctatggtccagtacaggtgattaagagaaaaaagtcagggtatcactttttgataggtattattcagctttgatgaactaactctggtatctagtttgagtgtatatgaataagagtggggaaaaaaggcagggaagaagaaagggagtatttttaaaaaggcacatactagtctaaacagggagagaaaagagcaatatttttacattcattttttgataataaactagtaattccagtctatcaagctgattaccttaagattatattaaccagacctcaagctgtcaccaaatcaaacacagtgatacatcagcagtcacaaaacagcttaattcaatgacaacattatttcacatattcaaataagctcatttttaagtgggataaccacatatctttgtgggggaaaagaaaacttcaaaatgtaaaatgtgttaatacaaaatattacatcagagaagaaaatatggctatatgtgaaatgaggggaaatggaaactcagatgtac

SEQ ID NO: 340316 - DNA, 296 bp, Homo sapiens
gcccacacaacataattttaggatacttcacactattcaaggtaagtacacaaccaccaccaccaccaccaccaccaccgaaacagcaacaacaaacatgctatgattaaagagtattacgctttgctctttctgtagtccccaagaaagcctatttggtcctccctatggtccagtacaggtgattaagagaaaaaagtcagggtatcactttttgataggtattattcagctttgatgaactaactctggtatctagtttgagtgtatatgaataagagtggggaaaaaaggca

SEQ ID NO: 340317 - DNA, 183 bp, Homo sapiens
ccataaccctaagaaaaagttaagaactactgctctattagaaatgaaatgttttatgctttgaagatgtttctggaaaactattgattttctgttctgtttactttgaattgcttggaagataatttgaaaattgacctccaaagaaacttagtcagcgctgtgtgtggaatatattgtaaa

SEQ ID NO: 340318 - DNA, 144 bp, Homo sapiens
taatggctgattaaaaacagtatttgaaaaccaaagagttctcagttaaaataatttccctaaaaagtagttaatgcgacgttttgaaaacatttttaaaatattaaatcagatgttaatgcagcgttaactcaaaatcaacga

SEQ ID NO: 340319 - DNA, 249 bp, Homo sapiens
gggtcactgcttaagcaggaaataaaactgagaaggggctaaaaaggatgatcagaaaggaagattaccacagaaatctgtatcctatgtaaaagttaaaatgaaatctaaaaaatatttctctaaactcaactgtccttgtagtttaaatcatcgaatttttcattggcgagcctatcctttactgctagtctgtcctaaaaccagttgtcatatagcattagcgacatgtctcatgccttacctgta

SEQ ID NO: 340320 - DNA, 288 bp, Homo sapiens
aaactcataactaactctcgtgtaaaaaaatcacatcccaacaaatatctcatttattaaatttaaaaattgacaacaatttttttggttctgttgagtcacttacattgtgtttatttttagacgggggggaaaatattaaatacttactactaagaaaatgtaacacaggacaatattgataacaaaatttacccaaatctacactctgacttacttattgctattaaggactgaaaacatgtgctccagaaaagcaggattttgtgtctggtttgttcactgctg

SEQ ID NO: 340321 - DNA, 499 bp, Homo sapiens
gttcccatccactctctccacctctgtcactttccacggtgagaggactttctgaaaatgtgaggcatattaacgagttctatagcagagaagttcttcctccctcctcaaagatcaggagaaatgatcaatcaaaattctggagaattttaagaaaaacaagagtttcatgaagtataaacattgaaaggttcatactagaccacatgaagtatgatgtatatccttatgccaagaacaccaggaagtcaccaacactgatcctaacccagcgtaattgctactagaaggtgaccttggccagctgcgtacatttccaggtctcaaccacgttaccaacaagggagggtgtaactcacatgactatctgacaagcataatgtaatgtacccattagtaaacgttacaagcaacgtgcacagccctttaaaatttccttacattcctcatcagccctatgaagtatcttctgtctactttagcaaagaaccacctgagg

SEQ ID NO: 340322 - DNA, 282 bp, Homo sapiens
ctcttctgggaatctgttctgtagaaataaaagtatcaacatataaaggtatatgtatggatatttttataatgtttccaatatttgctactaaaaacagcctgaatatccatcaatagtaggaagtataaattgtcatttacctgtactgtggaatatttcgcaactcagagaatgtgttataagtctgtatgtatttacctggagggatgtctgtaatagattgtagagtaagacaaacaagttataaagaaatgtgtataataagatcccatttttata

SEQ ID NO: 340323 - DNA, 498 bp, Homo sapiens
ccggttcaatgtgtatgtgccacttacaatctagatttatgatcatgcctcttagtctccattttcccaaattaaatccatgtgatctcatctgcagtaccctctcaggcttcagttatgtcagttctccaatgggagacctcatctagctctgtcgcagttcaggattagactagataaagcccaaggtaattcccctttcctgaagcaatgtaaattccgtagttttagcctgtcctgttttcagcctcctggaattgcctcaagtgaaggcattactgttctatagcttttcattcactatgaaaaatggtcccaaaattatcttcagcattctaattgaagcagatagcctgcattgcaccttttttcatagtcaccaattgcctaaaataattagctattataagtgtccttcagttcctcctcttaataattttggctgctctttaagtttcttgacctctttttgtgccacagtacatgcagaagtgtgtg

SEQ ID NO: 340324 - DNA, 309 bp, Homo sapiens
caggggagtgcagcatgtacccttgggctggcctgcaatggccccactctcctgaaataggagtgcattccaggtactatgtgtcctagcatacaaggtctctgtcggatcacgcataagccatgtgatgcactgagataagaagaaataaacaccaagatgccccaagataacaagaaggatcgaaatagctccatgttcagtaaatccttcatcatgaaaataatgcctcataacattctgttcttacttcccaaaccactagtacttggtttttcaaattcacattgattttgtacatgaggtctg

SEQ ID NO: 340325 - DNA, 470 bp, Homo sapiens
aaacaaaatcagggtcataataattaatactgctgaatcagattcaaaagattggtgtttctgtggataaattaccattttcatttgatgaaatggatttacttggggattggttgaatcaccggatcatgcaattctaaattattgtgttagcattataattgatcctggccaataggagcgaggagagagatagctttcctttttctacctgaatgtcctgctctatcttcaagcaagaatgtagcagggctggattattgtttgtgcacctaatccattgagcagtgttcactagttgttgcgagaagtcagggaccccaaacggagggactggctgaagccatggcagaagaacgtggattgtgaagatttcatggacatttgttagttccccaaattaatacttttgtaatttcttatgcctgtctttacttcagtctcttaatcctgtcagctgaggaggatta

SEQ ID NO: 340326 - DNA, 372 bp, Homo sapiens
aattatggtgcttaccaaccaaagacatgaaaattgtctctatttgtttgacaggggtatttgttttcaacaatgtcagcactttgacctcttcaggcatgattatcaaatgcattttgaacataaaacaactttagcatttctaaatatgagtcaaaaggacaaacaggtcaactctcacccttccctctagttgaagatatcccttactgccgagtgggttgtgttctctaacatctgttcaagaactgaatgccacattctttatggggtctggacctgtatctacttagtaccatcatatagtaactgtgttgtgtgcaaggaaatggtacagaacatatgataaagacaagagttcctcaagatata

SEQ ID NO: 340327 - DNA, 102 bp, Homo sapiens
taaactgtaccccttcacaatcttaattttaaacattactctcttaactaccacccatctcccgcaagtgtttcttcattccatctagtataaaatgtttag

SEQ ID NO: 340328 - DNA, 619 bp, Homo sapiens
aggaaatgaccggacttaatgtgcttgtgacctagttccaaccaatgaggaagaagggattgacagagcaaacaccaaaatgagcaggaaagagaacactgacagtctgtaaggacaggccaggcagacacctgtgccccagccaccaccaagacaggcctcaaccgctccaggtaccgaggcaggtccacacccccctccgcagagccacggcccatcttctccaacttcccgtgggagaatgaggtccctgaacggacttgggtggctgctaggggagtgagctccgcaggtgccctcagtgtaaaggacgcacatgcaaagtgcttccttgtttcagtgattactaagcattacaggtgatgcccttcttactcccttgaaccccaacaagagttctctctttgtccacgaaacaatcccaagtctctgtcctgatggtgtttacagtctaacagagagcaagatgagtgaggttcaatctcagctttgcatttgttgacaacattgcaatgctcggaatccaagaaaggcagatgagtccttgcttcactgagcttacagtcctgtgggggaggcagaaactaaagctactgcacgcgtgcacacaaacacatac

SEQ ID NO: 340329 - DNA, 88 bp, Homo sapiens
ccatacaaagttgcaaaaatatttactattagcaatttaagtccaacaatatataagaagaataggccagttgtggtggctcacatgg

SEQ ID NO: 340330 - DNA, 613 bp, Homo sapiens
atacattattaatgtattcctccaatactgacctcttacactcggctaaacattaaagatggaatgaactggacctggttctagccacgaaagaactgatagtctactaagatatatacaataatcagtggtgtgacctgaaggataacaagttagagttaactacaaaaagtgtaggaaataggggtgggacaggaagaaagatccaggcaaaagcaacatcatctacaaatgttaaggggcaagaatgcacagggcaagtctgagaaactgagatggggcttgggttgtaaattgataagcaattgaccagcttccccagcatagcattaaatgactatgatataatttctttcatatcaaaattatattttattacagaccatgggacctctgagattaaacaagagttttctataccatggaggttaaaatcttttagtagcaacctcatactttacctacctgatgattagttaagtaacgtgaaatacatatcttccacatcatctgtattactttggggcttatcacaagaattgaatatagttgatgcctaaaaacatatctttagtcacttgatgcctctcacacaaacacttctacaagcaga

SEQ ID NO: 340331 - DNA, 617 bp, Homo sapiens
gatcttatggggctttaaatgattgcaagagatcaaggtcccctattttctgtctcatctgggagattgagcctcacttaatgcaggtgctttcttctcatatctgcctgccaagaagaaaatagagaattgaatggttaagcctaggaggtacttaaatgtttaagcccacatagaagatgagcaaccccagattaggtcatgaactcaaatgctggtttctcttgggtcttgcaaatcaggagtacctgtttctgcatatcctggggcttctgcttttgcctttggatccgggggttgggaggactcaagggacgttccagatgagagtgtagaaccaattatgtgcggaccctttcttgcaactagtagatgttctccctgtggaaatttgctttggcattttcccatatcttcttttcagtgtcctaactattaaatcttgttcctcttacactttgcacatactgaggttctcagtcagaaagttcttaccttttgtttccctaatttcaacttactccttaattcagcctccaacttccaatactgttgtccttcctttgatattctctttccccatcttttcaggtaagaactccactttataaaagctc

SEQ ID NO: 340332 - DNA, 354 bp, Homo sapiens
ggggtgttggtctggcgtttatgggaaaggctggggatgctaaatgtcctatactgcctgggacagtcccacaaaagggagctttctactgcccaaaataattaatagctccccaaatagaaacactgttcaaatgacttttcagactaacttctcatgacgctattaggagagggggtaaaggcaccaaatcacggtgatcttaagtggcctcccgaaggtctcatgtacagcgctctactgtgattctctgcgtggcctttactgcctgacatttacttgggtatttgcttactgcctgtgatcttcccaccagaaagtgagtcccacataaacaggggtctagtcctaatt

SEQ ID NO: 340333 - DNA, 229 bp, Homo sapiens
aggtgtgagccaccacacccagcctattttcactctcttaatgatgtctttggaagtgcaaaagttttgaattttgaagaagtctaatttatcaattttattgtgatctatctatctatagagctatacatacagacatttcctgatttacaatggttcaacctacaatttttgactttactgtggtatgaaagccatatacatgcagcagaaatcatgccaagtaccc

SEQ ID NO: 340334 - DNA, 163 bp, Homo sapiens
cagtggactgttcggagggagaggcatgcggctggaaggggcagcagcacagtcgccctgggtcacagactgacttccttttgaggaagggcaggaagtcccctgtggccagaggtggcaggccgcggggaggggacggggaggtgggcagtggatcccagcg

SEQ ID NO: 340335 - DNA, 3280 bp, Homo sapiens
  misc_feature (1207)..(1207): n is a, c, g, or t
  misc_feature (1209)..(1209): n is a, c, g, or t
  misc_feature (1324)..(1324): n is a, c, g, or t
  misc_feature (1696)..(1696): n is a, c, g, or t
  misc_feature (1706)..(1706): n is a, c, g, or t
agcggagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcagcttcatcctcatctgcgatttctgcacactccccatcagttattgtagctgttgtagaagggagaggacttgccagaggtgaaataggaatggcaagtattgatttaaaaaacccccaaattatactatcccagtttgcagacaacacaacatatgcaaaggtgatcactaaacttaaaattttatcacctttggaaataataatgtcaaatactgcttgtgctgtggggaattccaccaagttgttcactctgatcacagaaaatttcaagaatgttaatttcactactatccaaaggaaatacttcaatgaaacaaaaggattagagtacattgaacagttatgcatagcagaattcagcactgtcctaatggaggttcagtccaagtattactgccttgcagctgttgcagctttgttaaaatatgttgaatttattcaaaattcagtttatgcaccaaaatcactgaagatttgtttccagggtagtgaacagacagccatgatagattcatcatcagcccaaaaccttgaattgttaattaataatcaagactataggaataatcacactctctttggtgttctaaattatactaagactcctggagggagtagacgacttcgttctaatatattagagcctctagttgatattgaaaccattaacatgngnttagattgtgttcaagaactacttcaagatgaggaactattttttggacttcaatcagttatatcaagatttcttgatacagagcagcttctttctgttttagtccaaattccanagcaagacacggtcaatgctgctgaatcaaagataacaaatttaatatacttaaaacataccttggaacttgtggatcctttaaagattgctatgaagaactgtaacacacctttattaagagcttactatggttccttggaagacaagaggtttggaatcatacttgaaaagattaaaacagtaattaatgatgatgcaagatacatgaaaggatgcctaaacatgaggactcagaagtgctatgcagtgaggtctaacataaatgaatttcttgacatagcaagaagaacatacacagagattgtagatgacatagcaggaatgatatcacaacttggagaaaaatatagtctacctttaaggacaagtnttagctctgntcgaggatttttcatccagatgactacagattgtatagccctacctagtgatcaacttccttcagaatttattaagatttctaaagtgaaaaattcttacagctttacatcagcagatttaattaaaatgaatgaaagatgccaagaatctttgagagaaatctatcacatgacttatatgatagtgtgcaaactgcttagtgagatttatgaacatattcattgcttatataaactatctgacactgtgtcaatgctggatatgctactgtcatttgctcatgcctgcactctttctgactatgttcgaccagaatttactgatactttagcaatcaaacagggatggcatcctattcttgaaaaaatatctgcggaaaaacctattgccaacaatacctatgttacagaagggagtaattttttgatcataactggaccaaacatgagtggaaaatccacatatttaaaacagattgctctttgtcagattatggcccagattggatcatatgttccagcagaatattcttcctttagaattgctaaacagatttttacaagaattagtactgatgatgatatcgaaacaaattcatcaacatttatgaaagaaatgaaagagatagcatatattctacataatgctaatgacaaatcgctcatattaattgatgaacttggcagaggtactaatacggaagaaggtattggcatttgttatgctgtttgtgaatatctactgagcttaaaggcatttacactgtttgctacacatttcctggaactatgccatattgatgccctgtatcctaatgtagaaaacatgcattttgaagttcaacatgtaaagaatacctcaagaaataaagaagcaattttgtatacctacaaactttctaagggactcacagaagagaaaaattatggattaaaagctgcagaggtgtcatcacttccaccatcaattgtcttggatgccaaggaaatcacaactcaaattacgagacaaattttgcaaaaccaaaggagtacccctgagatggaaagacagagagctgtgtaccatctagccactaggcttgttcaaactgctcgaaactctcaattggatccagacagtttacgaatatatttaagtaacctcaagaagaagtacaaagaagattttcccaggactgaacaagttccagaaaagactgaagaataatcacaattctaatgtaataatatatcttaattcaaggaacctagaatttatttttctccttagagataaggaaaataacatttgccaaatttcatattttaattgaaaattacattatattaacatcacaattgtcatctatatattctatatgaaaaatatttattataacttaacaaatgagaactacttaaaggaatggtttttatgttaggagaaaatacaatacaccacttttttctcacaaaaattcacattattaagacctaagttcatttatacttacaagttatagtttaaaatattattgtaaataccctagtttaataaacacctggcctcgttggccttatcgggggagcca

SEQ ID NO: 340336 - DNA, 3272 bp, Homo sapiens
  misc_feature (1207)..(1207): n is a, c, g, or t
  misc_feature (1209)..(1209): n is a, c, g, or t
  misc_feature (1324)..(1324): n is a, c, g, or t
  misc_feature (1696)..(1696): n is a, c, g, or t
  misc_feature (1706)..(1706): n is a, c, g, or t
agcggagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcagcttcatcctcatctgcgatttctgcacactccccatcagttattgtagctgttgtagaagggagaggacttgccagaggtgaaataggaatggcaagtattgatttaaaaaacccccaaattatactatcccagtttgcagacaacacaacatatgcaaaggtgatcactaaacttaaaattttatcacctttggaaataataatgtcaaatactgcttgtgctgtggggaattccaccaagttgttcactctgatcacagaaaatttcaagaatgttaatttcactactatccaaaggaaatacttcaatgaaacaaaaggattagagtacattgaacagttatgcatagcagaattcagcactgtcctaatggaggttcagtccaagtattactgccttgcagctgttgcagctttgttaaaatatgttgaatttattcaaaattcagtttatgcaccaaaatcactgaagatttgtttccagggtagtgaacagacagccatgatagattcatcatcagcccaaaaccttgaattgttaattaataatcaagactataggaataatcacactctctttggtgttctaaattatactaagactcctggagggagtagacgacttcgttctaatatattagagcctctagttgatattgaaaccattaacatgngnttagattgtgttcaagaactacttcaagatgaggaactattttttggacttcaatcagttatatcaagatttcttgatacagagcagcttctttctgttttagtccaaattccanagcaagacacggtcaatgctgctgaatcaaagataacaaatttaatatacttaaaacataccttggaacttgtggatcctttaaagattgctatgaagaactgtaacacacctttattaagagcttactatggttccttggaagacaagaggtttggaatcatacttgaaaagattaaaacagtaattaatgatgatgcaagatacatgaaaggatgcctaaacatgaggactcagaagtgctatgcagtgaggtctaacataaatgaatttcttgacatagcaagaagaacatacacagagattgtagatgacatagcaggaatgatatcacaacttggagaaaaatatagtctacctttaaggacaagtnttagctctgntcgaggatttttcatccagatgactacagattgtatagccctacctagtgatcaacttccttcagaatttattaagatttctaaagtgaaaaattcttacagctttacatcagcagatttaattaaaatgaatgaaagatgccaagaatctttgagagaaatctatcacatgacttatatgatagtgtgcaaactgcttagtgagatttatgaacatattcattgcttatataaactatctgacactgtgtcaatgctggatatgctactgtcatttgctcatgcctgcactctttctgactatgttcgaccagaatttactgatactttagcaatcaaacagggatggcatcctattcttgaaaaaatatctgcggaaaaacctattgccaacaatacctatgttacagaagggagtaattttttgatcataactggaccaaacatgagtggaaaatccacatatttaaaacagattgctctttgtcagattatggcccagattggatcatatgttccagcagaatattcttcctttagaattgctaaacagatttttacaagaattagtactgatgatgatatcgaaacaaattcatcaacatttatgaaagaaatgaaagagatagcatatattctacataatgctaatgacaaatcgctcatattaattgatgaacttggcagaggtactaatacggaagaaggtattggcatttgttatgctgtttgtgaatatctactgagcttaaaggcatttacactgtttgctacacatttcctggaactatgccatattgatgccctgtatcctaatgtagaaaacatgcattttgaagttcaacatgtaaagaatacctcaagaaataaagaagcaattttgtatacctacaaactttctaagggactcacagaagagaaaaattatggattaaaagctgcagaggtgtcatcacttccaccatcaattgtcttggatgccaaggaaatcacaactcaaattacgagacaaattttgcaaaaccaaaggagtacccctgagatggaaagacagagagctgtgtaccatctagccactaggcttgttcaaactgctcgaaactctcaattggatccagacagtttacgaatatatttaagtaacctcaagaagaagtacaaagaagattttcccaggactgaacaagttccagaaaagactgaagaataatcacaattctaatgtaataatatatcttaattcaaggaacctagaatttatttttctccttagagataaggaaaataacatttgccaaatttcatattttaattgaaaattacattatattaacatcacaattgtcatctatatattctatatgaaaaatatttattataacttaacaaatgagaactacttaaaggaatggtttttatgttaggagaaaatacaatacaccacttttttctcacaaaaattcacattattaagacctaagttcatttatacttacaagttatagtttaaaatattattgtaaataccctagtttaataaacacctttctttttaggtctggaaac

SEQ ID NO: 340337 - DNA, 264 bp, Homo sapiens
tgattgtcaggctgatttctcttcccatctccacacttggtctgtcctgccttgcacagaggcatgcagacaccccagtatacttgtctagactctgctcacacctatggtaatagctactcctcaggccaaggggtgtggtacatgctggacccagtcttgaaaaaagaggtcctgtaagacctagaagcaggcttgggtgatttgagtgtgggattctagagttctgtgtgtcttggcatccggtcataaaatcagtgggca

SEQ ID NO: 340338 - DNA, 803 bp, Homo sapiens
ttacacagatgatatattcatttagtaagtcaatgaatattcattgagtacttactatgtcccaggcattgttgtagatcctgcagtagtgaataaaattcttgtccttgtagaacttctattctagtgggagagctcatcaataagcaagataaataagtaaaatacagaatatggtaagtgctaagaagaaaaaataaagcagaaaaaagacaatagaaattcaagggaggagggcatttgaaattttaaataaggtagccaaggaagtcctcactgaaaaactatctttggagtaaggacttgaaggaagtgagggagctacctgtgtgaagggctaggagaagcccagtaatccaggcagattaataacatgtacaaaagacccaaggtgcatgcctcaaagacggcaaggagaacagtgagccggtgctgagtgaatgaacgggagagtactagaaaaagatggggagcatggggtgtagaccgtgccatatagagccttgttagtaagaattctaatgagaagtcattggattttaagcagaagagtggcacaatcagatttttcttttttttttttaagagatggggtcttgctatatcggctaggttggtcttgaactcctggcctcaagcattcctcccacctcagcctcccaaactgctaggattacaagtgtgagccaccgcaccccgtcagcacaatcagactgacattcgaagagcattattggttggctgtattgagaacagattgcaagggggcaagggccaagagaccaattagggtggtgttattc

SEQ ID NO: 340339 - DNA, 298 bp, Homo sapiens
acagtatgaagagaaaattcaaatgagaatctaatttcagctttgatgccagttactcttgtgactttgaggaagttctttaactctgtttgtattgagtttaagagaggtgacttctaagagttctgccagccttaaaattatttgattctgtacatttttccttagctctaaaatagggacaataatatttgtactatctcacagtgttgataggagaattaagttcttttactcaatagaatctgtaattttgcatttgtgtaattatttgcttaatgcctatcaccccagcagg

SEQ ID NO: 340340 - DNA, 306 bp, Homo sapiens
ttctaaatatctttatagatctgatttaaagctatgatcagggaggctgaagtgactagaatttgtggagcagaatgctagaagggaaataatttcacagagaggaaactctggcaatctgcataagagtgcccttgaatctctggctgggaactgggtacagggagaaactccaggaggctggggaaaggagtacttgaaagttgaacaagggaaatttgaaactatgttgaacagaataaaattgaaaacagtatagcagactgtgtgggatttaaactaaggcagtgtggagggaaatttata

SEQ ID NO: 340341 - DNA, 310 bp, Homo sapiens
cctcggctccctcatctgcagagccaggaggaggacgcctcccccaggatggaggtaaaatacagaacacctgataactctgaatttcagataaacaacaagcagcttttctagtataaatacatcccaaattttgcatccttacacaaaaaaacaaagtcatgcctggggtatctgcaattcgggtttactgggcatcctgttttcattcgcaacctctggcagccctactctacctgacccaccttttcataaagatgaatgagccccgagccctgccttctggagtacctgtcaccgtggtgtcccc

SEQ ID NO: 340342 - DNA, 813 bp, Homo sapiens
gtgtgtgtcatgagatacttatagcaagaattttcattgataacttagccaatgtttattgaacaacaaccatgggccagacactgggtcaatgctctacctatcattgacctatcttttcacttgtcatctaaattgaatcctcgcagtgggaaaggcagtgtcatccctgttgacgtgatctggaaacagtgcgttagagagtataggagacttgccaaggtattatggattgaattgtgtccctgaccccaagaaatgtgttgaaatcctaaccttccccacctgtgaatgtgacgttatttggaaaaagggtctttgtggatgatcaagttaggaaggagtcattaggatgggtcctgatccaatatgactggtagaaaaaccagggagatttggacacagagggaagaccatgtgaagactcagggagaagaggaaggacagccatctgtaagccaaggaatgccagcgatttctaggagggaggcctagacgagatccttcccccacagtcctcagaaagagccaaccctgccaacagcctgatagcgaacttttagcttccagaaccatgagacaatatatgtttgttgttgaagccacttagcctgtgatactttgtatgggagccccaggaagtaactacacaagctcacccaaactgtgggtggtggagctggtgtgtatgtgtccaggccctgcctgtccccgcagttatgcagtgtagcctgcacactgctggtttccttgatgagggcccagccagtgcctggatgtgctcccgtgggccttggatgtttaggagttggt

SEQ ID NO: 340343 - DNA, 545 bp, Homo sapiens
agcagggagagggaagccagagaccagtggtcctgctgtgttgaggagatggagatcagtgtcaccggaggccaaggtgagtaagtgagaggagaggaggcagcagcacacagacagagagtgctgtagatctgcagtgggtcccctggagtccttggttgagtgaaggtgttagaagaaactacttaagccaagaaatgagtaactggaaattagtagagcaaataatttacagatcatctatggggctgggaaaagtttgtgtttccactagccagagtagaaataactcataatgcatgggtcatcaggtggagtcctccaacaggtgttgccttagtactgaggtcaaattgtccctagaccaaaggcttctttggacttcccctaacaaagcttaaagacaagccttggaaggatcaaactaatttcaagaaacttaactgtgaatcagaataaaacccaataccatttataggaatataacaaaatccatcaacaaacaacataacactcataattaccaacattcagtaaaaaattac

SEQ ID NO: 340344 - DNA, 331 bp, Homo sapiens
ccatttccaaaagtcacttcttactcaataacagacacctctgttcacagagatctactgtaatacaccttacttctgctttcgctagaactgtctctttgtaaccttcatccaaaacctcctaagaaacagatcaattctacaccttcaaatgacaaccttttctgttgccaaatccagggactatgtatcctctgagtactaacttctgtaagacaaaagtggactttgagtagggacatgtatgtgccaaggaagtcagctgcacgtcagagagttagaattttgctcaaggagtaacttagctgttggttttctacctaaagcaaag

SEQ ID NO: 340345 - DNA, 1355 bp, Homo sapiens
gtattggcgcacgatggcgcgtccctaagttttcagtgtagaagggggtgtggctctcggagtttggggaaagaataaaggagatgggcctgtctctgagtgggaaagggctactggacgggctccatgtagtgactgagcgcctgagaggggtttgctccctagctttgtgttcggggagggtgttgggaaagcggtaaggagtagggtggctggatcttgtttggagagggagatgtggtcagggttcttgccttagtaaggaacaaatctagtgttgtgtgttcctaccagagccagaaaggaagggcccaaagctccagaattcttcctggtcctcgaaggagggaactagaatttctgctgtaggaggtacttatgcagtaatctcgttgggaggcggagactggagttggagtcttaagagttgtgtatttgcgaacatcctaagcacgttcttggttatttcaatggtagcttattggaggtgcttgggacatggggggaggcggaaacctggtaagccaactcgtgatgctgccactatgaatgctttccttgcacttttaaacaaagaaattatcaagagtgacgagtttgatgaatttagaggctagaaagtagagggttcctatttcattagattttccagagagattggattttaaggatggagatgcattaagggatctgaactttggtggaagtaagtttgcgtgaacttttagtgtattttaaaatccttttatctttcaaaaattgacgtgtaagacactttaattagtaataaagtgtgaaataatgttttcccagtgtgtgaaattgtaggcttgcatggttgtactggttcccaaatttcaccatgataccatgtgtagtattttttttctttatatttagtggacagaaattgtaatggattgatatggatactaaaggtgttgagagtgttatcacttgaacagctgtcttatgattctttccgattgaaatggattacaagtgactaatgaaaggcaagggatcttgttaggaagtgctgagaagtggtaagtcagtacaaattgaagacggacattttgaggtaggattgtggttaggatggagggatagggtaagggtcttcattttaaggataaatgttagtaaaaagaataaatatgtattttgagatattaaaattatatttgcaccaccctgacacaactgtttcacttatgttattaatctgttgttcgtaggtaaaaataagcatgagtcccaaggaagcatacagtttaaagagaaacattactttctagatcaattcataacatttgcagatcgtaaggttttttagaccattttttttttcc

SEQ ID NO: 340346 - DNA, 602 bp, Homo sapiens
gatgattcaggggcctcagaaacccacagctagagtgtaggtttgtctcaatggatccagcaaccgtgtccctatgtccagcaatctcccacccatgtccctggacctctccagagcattggacaccactgacctggccaccctgaggtcccctcacaggatttcaggccattatgctttccaaggccttcatcctcccacgctggtgggcgccagggtggctggggaatgggcctgggtgtctgaatgttgatcgcaccccgagtggttctgcgcacatcagggggaggaccctggggctctctggaggctctgcctcctcctctttcacctgcccctgagtgtgggtgtgcccctgaggtctgccctcaccctcttcccaccttttctcccgtgagctcacctgaccccacggcctcagctcccgcctccaagtggcaactgacagattttctaatatccagctcagttgttactcccaagctctggcagcctgtggcagcttcaccttggacctgctcttcctctggattccccacttgctgtccttgtcctaacttctgaaggtgacgtgtgaacggtgccctgaggctgtgacctgt

SEQ ID NO: 340347 - DNA, 170 bp, Homo sapiens
ctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggaga

SEQ ID NO: 340348 - DNA, 544 bp, Homo sapiens
gctccgcccctctctgctgctcctgccctctctctgctcggccccttcttcttatgcaagggggcttataaagccaacgggatctgcaagagcagatgctcgcaggggctctttgatggaggattatgtatccaaacagttcctccctggtatctggtgcactgaaaggctctgggggttcaaggtgcctgtatggggaagatgctgaggcctctcagtagtctctgaatactggaagtataaaaagcgagaaattccataaaagtagagaaagtgtcaaaggacagagtctaggaattgaagagtctctcaaggcagatggtaagaggggtctctgagtagaaatactgggcagagtctctgatggaagatgctagggccagggtggggttaggagacctgacgtgtggcgaagaggggcccccgacacaaaggccaggcccaaatggcctttcacagggtctagtacccctggaagctctgagcgcggctagcatgtgtgtgggatgggggtctgaaggaaaatgctaaagaggactctctt

SEQ ID NO: 340349 - DNA, 470 bp, Homo sapiens
gggaggctgaggcaggagaatcgcttgaacccaggaggtggaggttgcagtgagctgagatggcgccactgcactccagcctggacgacatagtgaaacaattctgtctcggaaaaaagaaaaagaaaaagaaaacaagaaggcctgtggggggaagggacatctgacaatgatcctggggtccaaggaggctgaaagcagaagctgaaaacccctgactgcagacgttagggaccttgaaacgatctgagggcagattctgaggcctgatgtgaggataagggatctgtgaaaaaagcagctagaacccaggttggtttttgaaggcagaggctgggtctagggtggggttggggaggcgagtctctgatggaaggggctagaagccaacgggatctgcaagagcagatgctcgcaggggctctttgatggaggattatgtatccaaacagttcctccctggtatctgg

SEQ ID NO: 340350 - DNA, 694 bp, Homo sapiens
gttcttcctgtagggctgaagcagtgcctactcgatagaatcagtcatcatgcaaataaaagccacctgagtcaaaggcaaagccagagtgcagcttggagcaaagaagagttaaaagcatattggcagaggaagagccctggcattccagcaggagctaacaggaaaaagaaaatcaatggcagtagccctgacacattcacttctggtggttaccactcacctggggatgtgagtctcggcgggccaggctcctggggacagggggcccaaggggcagtagagggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagag

SEQ ID NO: 340351 - DNA, 729 bp, Homo sapiens
agcctttgatcttacaacccagtcccctaagttttctcaccccatttctggttcctctggttgcagcacaaatttccagctggaaggggagtggagactatgggacctaggagcaaagagttaaaagcatattggcagaggaagagccctggcattccagcaggagctaacaggaaaaagaaaatcaatggcagtagccctgacacattcacttctggtggttaccactcacctggggatagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagag

SEQ ID NO: 340352 - DNA, 776 bp, Homo sapiens
gttcttcctgtagggctgaagcagtgcctactcgatagaatcagtcatcatgcaaataaaagccacctgagtcaaaggcaaagccagagtgcagcttggagcaaagaagagttaaaagcatattggcagaggaagagccctggcattccagcaggagctaacaggaaaaagaaaatcaatggcagtagccctgacacattcacttctggtggttaccactcacctggggatcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagag

SEQ ID NO: 340353 - DNA, 272 bp, Homo sapiens
caggtgcatggtttatgcctgtatcccaacactttgagaggttgagacaagaggatgagttgagcctgagagtttgaggctgcagtgagctgtgattgtgttgctccacttaccagcctgggtaatagtgagaccctgtctcaaaaaaaggaaaagaaaaaagaaaaaaacactctgttctcaagtttcctattacttcttagtttaaacagtgatatttgggattcgttgattgtgagagtgaaaaagagagatggattggtccgagcgga

SEQ ID NO: 340354 - DNA, 463 bp, Homo sapiens
ggtgggtcagggggaagggtttggaatgaagaagtgtgttgtagccagaagaaagaggcgagagaatgtgatcagcatgggaaatgggaaaggcccagtacagctggtgcatttatcctacttacagcaggaagacaaggaggggttttaagcgcaggtggggaggggacaatggaaaatgcacgcccagatttgcattttgacacaataaatctaggtgcaagctgctgggtacagaagtgacccactacgccctgatggacagaaataatcctgggcaatgccagaagaaaaaaaaaacaaaaaaactccacagtaaaaagaaagaaattctacccacaatccttctacctagagataaccacaataactattttcctccatagcctttgggtttatttttatggattaaaaacaattgagatgactctgaagagagagatttgtaccctgccttttcaat

SEQ ID NO: 340355 - DNA, 574 bp, Homo sapiens
ttgagggtccccccaaaggtttccaggggtcccagattaatgccctgcaatccagcctggtttacaaaacggggctctttcttttaaaaaaaaaaaaaaaaaaaaactccagcctgggcaacaagaacaagactcggtctcaaaaaaaacacctactggtcagtgtttggcatacagtgggtgtttctactgttttcagcttcatctctgcctaaggcacaaagtctttggctgatcctgggtgcccagcagtgcgtggcatctcacagtgtacctcctcagcatggagctgtgcagagttgggatctgagagaggctccagacacattcttaccctcgaggagtgtctggacagcctctttgcgggtctccctgccttcagccttcagccttcagccttgttcatttaatccattattttgaacacaaaagcccaaatctgatagggccaggcactcctggactctactgccctcaggatagagtccaaactgatctacagcctaggtttggggctgctgcttatattcccagtgcacctcacctgtcctgcgacctatgaggtaccgagcgc

SEQ ID NO: 340356 - DNA, 521 bp, Homo sapiens
ttgagggtccccccaaaggtttccaggggtcccagattaatgccctgcaatccagcctggtttacaaaacggggctctttcttttaaaaaaaaaaaaaaaaaaaaactccagcctgggcaacaagaacaagactcggtctcaaaaaaaacacctactggtcagtgtttggcatacagtgggtgtttctactgttttcagcttcatctctgcctaaggcacaaagtctttggctgatcctgggtgcccagcagtgcgtggcatctcacagtgtacctcctcagcatggagctgtgcagagttgggatctgagagaggctccagacacattcttaccctcgaggagtgtctggacagcctctttgcgggtctccctgccttcagccttcagccttcagccttgttcttgttgcccaggctggagtgcaatgccaccatctcggctcactgcaacctccgcctcccgggttcacaccattctcctgcctcagcctcctgagtagctgggactacaggtgcctgc

SEQ ID NO: 340357 - DNA, 528 bp, Homo sapiens
tgcagtggcatgatctcggctcactgcaacctctgcctcccgggttccagcgattctcctgctgcagcctcctgagtagctgggattacaggcatgcaccaccacacccagctcatttttttgtatttttggtagaaacaggattttgccatgttggccagactgatctcaaactcctgacctccggtgattcacccgccttggtctcccaaagtgctggggttacaggcatgagctacagcacccgacagagtcactgtgatcttaaatgactgctagagaatagaaggagtagaattcagattctaatgggctgaggagctagtgggaggtgaggcactaaagatagcaggtgtagacaactctctcaagaactcttgtagcaatgggagtagagagattagacagtagctggaaaagtaggtgagatccaggaaacgcttttcaaagttaggaaaatccaagtgtgttaatgctgatgaaaagaaaagcagcagccaggctcagtgacaacagcctgtagtccca

SEQ ID NO: 340358 - DNA, 371 bp, Homo sapiens
ggccatttccagagtcacctatctgccactttatgaatctgtatgccatatgccggctgctggggttacaggcatgagctacagcacccgacagagtcactgtgatcttaaatgactgctagagaatagaaggagtagaattcagattctaatgggctgaggagctagtgggaggtgaggcactaaagatagcaggtgtagacaactctctcaagaactcttgtagcaatgggagtagagagattagacagtagctggaaaagtaggtgagatccaggaaacgcttttcaaagttaggaaaatccaagtgtgttaatgctgatgaaaagaaaagcagcagccaggctcagtgacaacagcctgtagtccca

SEQ ID NO: 340359 - DNA, 248 bp, Homo sapiens
tgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgt

SEQ ID NO: 340360 - DNA, 908 bp, Homo sapiens
gtctgcctcagagacaaaatacagtccaacaagagttcttaatccatttcttattctcactttgtgtaaaaaaaaaaaaaaaaaatcatctgacatccagcttttctaggtgcccaaagcagttctccctccagtgacagactccagggaatcccttcgattcactgccctctgtatgtcccagggcaactccctgggtcccattcctcaacatggattcatgggccacagccacgagccccacgtggagtaaacacagggccaagttctcaaggccaccctatgccctaacctggggtgacaacctcaactctggctatgaagggagaatcacctgtggtgttttttcattgttctccaaaagcctagcctcagcccactctgaaagtgactatttgggatgctggggtggaatccaggcaaatagattgaaaaagctctgggataaatgtcagaacagagggaggcagcatcccagaaaaaaaacctgaagcagaggagctgtgaacccccgagggaactagcaccccaaaaccatacaaagggcttcttccccaggggaggtgggctctaagaaattgctgttttacctttaaagcttctcaggttagtggggagagaacaaaagagacccgcctgacaaaagatttcaagtatcaagtcagctgggtaggtaaatcaggtccctggcttccaacggggctcgtttccctccaccttcctgttgcctccaggacctctggcctcctctcctccaggaccctccagggcctattgcacgcagcctcaggcatctgggctccaggtatcccactgctgcctcatgcagagaccttggcttctccttaagtgttgttgccagccttatctttcactccacctctagaacctcattgtgaccatctatg

SEQ ID NO: 340361 - DNA, 1640 bp, Homo sapiens
aaaaatagctttcttcattgtattagccctggcatctgtttttagggataaattaaacaccacagtatagatcttgtgactgtgtacacagggcccaaagatggaccgatcgtgtcctgaacgttgtttagagaaagatgggcacagcgtgccttactgtcggcacctggtggctgatggacccggaaccatggactccacttctgcttacccctccattcacagcctccttactctccccaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccca

SEQ ID NO: 340362 - DNA, 1691 bp, Homo sapiens
tcagaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagagtcctagtggagggaaacctttcgggtccttgtcatgtgctctccccgagtcaccattcaggtttctgaactggggctttcagtcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccca

SEQ ID NO: 340363 - DNA, 1583 bp, Homo sapiens
aaaaatagctttcttcattgtattagccctggcatctgtttttagggataaattaaacaccacagtatagatcttgtgactgtgtacacagggcccaaagatggaccgatcgtgtcctgaacgttgtttagagaaagatgggcacagcgtgccttactgtcggcacctggtggctgatggacccggaaccatggactccacttctgcttacccctccattcacagcctccttactctccccaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaaggtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccca

SEQ ID NO: 340364 - DNA, 465 bp, Homo sapiens
gcagcccgggaaaccacactgtcgttcggtaaaaagtggcacaaactgtgcagcgcagcggggtgcctggggcccttagaatctgcgagaggccacacccagctctcccagcaggcagaacaactctggggcacctgggatgggcaccgttagcagccctggcacagagccgacctccaccctttgtagcatcctgccaaggcaggcctcctccatggctggggtggcagggagtgttcgctgtcttcttagacctttgggatagaagccagaggcaaggcagggttcccattcagcggaacatcctagaggtaaagacaaggcccccaggccatgtgagtcaccaggtgggggctcccgcacatactccctcccctgccgctttgcagagaccactgagacccacagtcactaagcactagggccaccctggcccaggagagttggaagtgccaaggcaggatc

SEQ ID NO: 340365 - DNA, 1637 bp, Homo sapiens
tcagaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagagtcctagtggagggaaacctttcgggtccttgtcatgtgctctccccgagtcaccattcaggtttctgaactggggctttcagtcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaattcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccca

SEQ ID NO: 340366 - DNA, 95 bp, Homo sapiens
caacactgagataaacatttgggttttagaaatatgattttcctttcatcaagcaattagtagaataagtaggtggggtgtagggcgtattatat

SEQ ID NO: 340367 - DNA, 236 bp, Homo sapiens
ctgattagcctgtcactgaatacacaatttataaaaattgtcacttataccttagtctggtgtagtgaaataatagggtaaaaagagaaattagataagaatttgtctcaatcaagcagagggatgactgcattctgctgtcctttgtccacaaggaaattccttgtgtgcaaattgtgagggaggtaggtagcgtcttttttttttttttttttttttttttttttttttttttt

SEQ ID NO: 340368 - DNA, 2534 bp, Homo sapiens
atgggtaaaaaaaggaagggggtaaagaagtaaaaaagcaaagaaaaaaaaacctaagaaataatctaatcgaaacatctatttaacagatgaaaaactaagaaataatctactctaaacatctgtttaacagataacacagctgtgacatagggaagtaaagacatttggccaaggtcacatattcagtgaaagccagaactagaaccctggccccgtccttccacaatggcactctctcttgcatctcccagtgccaactgcctcctgtttaactcaggtctcccgggtttcagccgattctctactggccacacagcaagggccctctcaccttttaccacaccctacccaatggcaaacacagtgagctctagaggacaagggagagaggtggaaaacatgatgtgtttaccctctcattttgtcactcattcatgcattcactcactcacccacttatttatgtatttaactaccatttaccgagtacctcagtcacatggaacctggggcaggggatggagctcggtaggtggtacacacctgggtgtggcatcttcccgtcatcagatgtgcctacctgcttgcagtcacagcagatgaaacgtctctgccccgatgaaaggccaaccctgcctctttgctctgcatcccaccctactcacctttccaaggatttggccgctccaatgatcccgttttctgtttcatcagtctctcccttcaccctgcaaacatattctgctatcttctgtctttaaaaaatcctcttcctatccccacattcctctctagctaccagtgcctttctctgccccatggtctctgccttcaccttcttatcccttcctatcaggccaactctgatcccctcaagtccccacagtctctaactccatcataccaatggtcacttctatatcctcaattcccttgaccttttagctcatccctgtctcatgcctttgggtttgtgatgcccagtcttctgtttgctttgtaactcagttgtctttcctactcattctccttgctgtccttctctgttagagctctaaattgttgaagaaccccaggcttggtttctagtagtcttgtcattaaatgacagctttgtgcaatggctgaaatttatactctagtcaggattctttcctggcttcagacacacatgatgtacctgctgacttattaaaactggacatttagtaggcatctcaatcataacacggcccaaaaaactcttgatttccacttgccatctactacatcacttcccctcctggtctgccatatatatacttgccaccatcatccatgccccaaacctacaaatgattcttgtttcctctattttctcatcccaacagccaatctaccagcaaggtttgctggctttgcaaccaaaatatattttcagggtctctttttccctccttcactgctaattccctaactcaagccactgtcatctcttgcaagaactactgcaactgtcccctaactggtctttgtgctttctctcttgactatgtacaattcattttcctagaaatcagagtagccttttaaaactcgacccagccactacaattttgtgctaccatgctaaactagttcctgccttaggtcctttgcccttgctgttctttggtccagggatggtctgccccagtttatcacttgaatggtcactttgaacaccttctcagagaggcctcccctgacagcccaatctaaagtagttatctcctctccctggtggctctttattacatcatcccattttattgtcttcacagacaataaattattatgttcattcattgacttatttattgtccatttgtcttcaccattaggttataagctccaggaataaaggaatctgacttattcactgctgtatccccagcatcctatacagtagaccttcaaccagtatttgttaagtgaaaaagtggtaaatggatggaaggatggaaggatgaatgaaagtgtgaatgatggaaggattgatgatgaaaggatggatgggtgaaaagatggatggaaagatggacagataaaaggatgtatatatagaaagatgtatagattaatggaggaatagattgaaaaggggatgaaaagatggatataggagaggagggatgggtggaagaatggatgatgaaaggatagatggaaagacagattaaaggatagttctatgaaaagatgaatggacgaatgaatatggatggaaaaataaaaggattgatggaaagatggatggatggaaagatggatgatagataactgaaaagacagatgaattaaaagatggatggagggaccaggcacagtgactcacacctgtaatcccaacactttgggaggccaaggcgggcagattgcctgaggccaggagttcgagaccagcctggccaacatggtgaaactccgtctctaccaaaaatataaaaattagccaggtgtggtggtgggtccctgtagtgacagctagtggggaggctgaggcaggagaa

SEQ ID NO: 340369 - DNA, 434 bp, Homo sapiens
tctgcaatcgcaatgaacggaaaccagcatggtctaagggaggtagtggttcacaacatttagacataaaaacttttgtgggaattctggaaaaaaggctatgacatcagcttaaattttaaatctctccgaattccctcataaagtcagagaaaacctcatgcacaaaatcccaaaatataaggtggggaaaaaccaccaactgccacaagatctgtgtgggcagtggagtataatacaggggcatttgccagcccacagaacataaaaaaaaattaaaaataaaaataaccaacagggactctctatatagcacaacaggcaaaactgggaaaagtgtgtaaaaaggaatgagttttgcctactacaatagtacacaagtgcacgggtccacaataaagctttaaaggcatggaagactctagtcactacat

SEQ ID NO: 340370 - DNA, 195 bp, Homo sapiens
ttttttctctatctttatttctctttactagatagattgtatcattggcaaaaggtgactttgccctagccttaaacagttagcatcccattttatggatggtaccttgttcttgacatctgcaagaaaatttgaggcaagaaaagttaaatggaaggatagattaaagtattatgtgacatgttcgttccattt

SEQ ID NO: 340371 - DNA, 294 bp, Homo sapiens
catttcttctagttgggcttcctcaaatttttttttaggagtgattcttatacaaagaatatagctgtattttgctttttaaaaataaatctttaaatattctttaatagaatatcaattctatcacgttatgacacatttttatttcacttctgctaatatctcctattcattgtattttcctgtgtttcttcttttgccatttcttatttaactaattattcaagagtttaaaaaatattgtacatcataatagaatacccatactatttggatatcctactatatgttttt

SEQ ID NO: 340372 - DNA, 250 bp, Homo sapiens
atgtcatgttgaagggagttgaagaaagctatgaggggagttgtcacaatccagggaatccaggtgctgtagcaaggaattaaggaaacaggttttagaatttctttggagttagttagcttccacagaatatgggaatgtgggggtgcagaatgttgtcaggagggctgtaaagaaattaaaatagaaggataggatagagaggagcaggggcttccttagagtaggggacctctctgagacatgacat

SEQ ID NO: 340373 - DNA, 313 bp, Homo sapiens
ttgaagcaactgccaggaggccactgtagctaaagaagagtaacccagaaagaaaatcatgtgatatgaggtcagagaagcactaggccagatggtgaaaggccttgtgtgcctgacactgagaggctattggcagaagattgacatcgtaagatttaggctttaaattggttaccttggctgccaggttgaaaatagtctgtagagtgacaggtcctattgcagtaacccaggcaaaagatgatggtagcttgtactagggttgttacagtagagggcttaagacatggttgggttctgggtatattttgaa

SEQ ID NO: 340374 - DNA, 652 bp, Homo sapiens
gtctgtctgtccttcgcccctccgtcgccaagtccctatcgtttctcggcctggggagtccaggggggtccgggcagtggaacctgccaggtccccggagaccggccctcgatccctttgccgaatgcggcgaatagagacctcgaggttccgggacgtgcgcggggtcaggctgcgggcgactctcgcgaccccactctcagcccctaacggcgcccgctgcccgccggggggcacccgggaggctgcaggtgcccatttcctgtcgaggggctgcgagcacgtgtcgacaggggagggaaggaggggcgtccgttccgccgagtcacggcggccgagtcacggcggctgagtcacccggggcgtccctcccttcctggcctggagcggcccgggcccgggagtgggagatgccgccggcggtgcctcggacccggaactggggtcactgggacgccgggcccgcagcgcttgggctcgggctaccgctgtcgggacttgcctgggcttgtgggcgcttcccggacgattgggcgcccacacccagggcccagcggcagagctagaacccacttctcccagaacactgagccccatcccaacccactcctcagatagctggctgatagaatgggaacagggacgttgtgct

SEQ ID NO: 340375 - DNA, 444 bp, Homo sapiens
gatgaagccctgtgcactccaacctttagaaactgggaagaagaggatgaatagcaaagaaatggaaatggaacacctaatgaggtaggagaaaacccaagagcaggagacattttagtaattaaatgaggaaagtatttccataaaaagagatttctcaactgcatcctaccctactttgagattgaataaggtgaagactcaaacttaaccattgaattatataattgataccattaattaccttgacaaaattggtatggtggagtggggcataaaggaaactatggaactgggccaagggaataatggaaggtgaagaactggaaacagaatgcagctttgggaggccaagaggggcgaatcacctgaggtcaggagatcgagaccagcctggccaacatggtgaaatcccgtctctgctaaaaatacaggaattagcca

SEQ ID NO: 340376 - DNA, 263 bp, Homo sapiens
aagtgtgtgtttaccgctgaatgcttttgtgtgttctccacagttgtaatgagtttttcctctgtgactgatggccccaccgtcgcttttgctatttgattgctccccagtgtgagcagcctgttgatggagaaatcccaacttggccaggaagtccttcccaacttctctgcaggtggaaggctcccctgacacatggaatgtgcaggtcttcacaaacaaggctctgcccacattgcttctgaaatgtttttctccaaggt

SEQ ID NO: 340377 - DNA, 409 bp, Homo sapiens
tccatatgaatatcaccatacaatcacaaagaactccagtctccaacgtatgtatatatacacacaattttgtgtttgatcctttttgttttttgagacagggtctcattctcatcgcccaggctggagtgcagtggtttgatcatagatccgtgcaaccttcaacttccaggctcaagcgatcctcccactttagcccctcgaggacctgcgactaaaggcacatgccaccatgctcagccaacattctttttaatagatggataaacatgtcctaggttaaaaggactactatggctagtcacccacatgttttgatttccaacctagttctctttctacatatttcaagacagatataaatacttaaactctctggttctcaaagggcatgtgaagcaccccagca

SEQ ID NO: 340378 - DNA, 170 bp, Homo sapiens
cacaaggaactacttcctgtatatatggcttgggctttgccatttccaagtctttccctgcaattccctctctctgaaatatctctcccctgcttcacccctacggtccaaaaccctagctgtcctttaggatccagttcaaatggtacttccttcaaaaagccttccct

SEQ ID NO: 340379 - DNA, 298 bp, Homo sapiens
cattaaaaaaaatgtacactgaacccaagttcaggcttacatgcctccctttgtcaatttccttgtaaaattaagggattgtcattttaaacacttcattctattatctgaaacctgaatgccagaacgctccttccaaagctaatgatgcaaaatgttttgtggacaggccaccctggacacaaagactcagaatgaaaagaggtcttgagaaccccagtgctgtggtcccgctctgtggaactggtcacggcaggctgtggagaaccacacagagcagatcttgtggtcttgcttg

SEQ ID NO: 340380 - DNA, 257 bp, Homo sapiens
accacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgag

SEQ ID NO: 340381 - DNA, 552 bp, Homo sapiens
tggcttgcagatggctgcttaggaggtggggctgcagcagagagaagagcactgggcccagacacgcaggaagaagagaggccattgtgggaaactgaggtgctgttaaaagaaaacccacagtgtcacggaaaccaggcatcagcagtagcagcctctcagcaggacaaggggccaacctagagtccccttttgctgtggtgactcccaagaactgtgatggctcacctgggggaaggttctagaagctcccagcagcagcactgccaccctcagaatgcaggtctccaccaggcaacatcacattaggtaagagtatgcccctagtcattatgtggataggtgcttataccaaataccagggtcacagcccttgcaataacttgaccctcatccttgacaactctggagaacattacaaagcattatggctacaagctgtgttattcatttccagttgccatgaacatactttgttttggactgaaatgtcatcgtgcactaccctgaaagtcattttttacttgattggatgtttgacattgccaatag

SEQ ID NO: 340382 - DNA, 275 bp, Homo sapiens
cttagactcaattagaaactttaaaattaatcaaagacttaaacaaaagataataaaactataaaagtactagaagacatgggagaattcttttaaaatcttggcataaagagggtctttctaatgacagcatatccatattataaaaggaaaggctgattcgactatatgaaaatcaaaacttcagtcctacgaggtaggcaaggaaacggcggtgctggtcagtgggtcacttgccgtgtgccactcgaggtggatcctggattcaaacccag

SEQ ID NO: 340383 - DNA, 265 bp, Homo sapiens
ggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaa

SEQ ID NO: 340384 - DNA, 592 bp, Homo sapiens
aagttgtgacagtgggaaggtaaagggagataagaagacattgtgtatagtgtctgtggggattggctcgggaaaggcacaagaatcagaaaaaaaagttaaattttcttcctgcaagaagaaaggtggaaagaggcaaactaactggttaggaaggccaagactgaagggacaacgtaatggcagggcatcttatgaacctcacctaagggaagaaagcaaaccaggccccgtgtttcctgacctacaaacaaccaaaggcagcagctaaggcaggctcactccttgcccggaccaaacagaatcccagtaacgacacccaagtaagcacagtggcaccagaaaagcggacaacagagaaccgcactgacaacagtggtcagaagcacttctttccagactcccttcccccattaaagttcccaggcagccaggactgcggaagcaccttgtgcacccttgagaggcacctgcaaggatcgggggagtcctatcggcagcagatgaacaaaagacacccaaacagcaagacaaacgctctaaaattgaggtctcattggaaccacccacaaaagcaggccagaacctgagt

SEQ ID NO: 340385 - DNA, 405 bp, Homo sapiens
ccccctatgctgctggcttgcactgacaggtaaagggaggacttgctccagttggcattttcctctcttgcagtgagtgagttttgatttccattattatgttggaacttggttctattggctagaccaggggtcagtgaactatctctgcaacggactagagagtggatattttaggctttgcaggctacaggatctttatcgcaactgttctaacatgaaagcagccctgggcaatatggaaatcagggaatgtggctgtattgcaataaaactttacttacacaaacacattagcagttgcacttggccaattcttgtagctcatcagttccctgaggccacggagtatttttctgtcatgctgcccatctctcccttctctgctcctgggcgtggcccctg

SEQ ID NO: 340386 - DNA, 503 bp, Homo sapiens
tctaacattaaacaaacatacataagtaaacctttaattagtatacactcaaggtacatacattgttttcctttctccttctaaagcatggaagagattttttttttaaataagctgacaaaatatgaaaattaaaagaacacaaccgcatgcagaagtagcacagaggacttcctagaaattgtattctttctccagggagcaacaagaatcgttattcccaaaagggactctattcacttcacagcctggaaggtaatacctacctctgacagaacagaaactggcgtctggatcctagaatcacctagcagtagtcacaaataccttttttttttttttttgggtaatacgccatttaaagaaaattaatgttaacttgcaacaaagtaaatccttaaaaagaaaaagaaaagccccaccatccctgcaatctcccacccaaagacaaattataactcaacagcctatcaccaagattcagcccatcatctagattcatc

SEQ ID NO: 340387 - DNA, 139 bp, Homo sapiens
ttgtctaatggacatctcaatcctaatttgtctaaatctttgctcatgctttcagtgcaactctccctccatccccccaacacacacatactcacacatttacctctactcttctggcagccttctcatctcaataaat

SEQ ID NO: 340388 - DNA, 1349 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgcaactgaagaaatggctggtgcaattcagcaaggtaaaagattatcttacccccagctggttaaaggcagaagctatgaatttgtgctattgtctgtgggctcctttcagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340389 - DNA, 1457 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaggtggttacaagaagaaataaaatgttggctggcagaagcagcagggaagatttcatattgaagactaactagttctgagacgttttggatgtcttcttgcaaacaaaatagaatgcaactgaagaaatggctggtgcaattcagcaaggtaaaagattatcttacccccagctggttaaaggcagaagctatgaatttgtgctattgtctgtgggctcctttcagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340390 - DNA, 1461 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgcaactgaagaaatggctggtgcaattcagcaaggtaaaagattatcttacccccagctggttaaaggcagaagctatgaatttgtgctattgtctgtgggctcctttcagctttctgtttttctcatgcatgagaaaaatgcatttcagctgaaaacagtattatgaaggagaagtacttcaaaataaaacactttactcaacccaaaagactcactataagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340391 - DNA, 1380 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaggtggttacaagaagaaataaaatgttggctggcagaagcagcagggaagatttcatattgaagactaactagttctgagacgttttggatgtcttcttgcaaacaaaatagaatgcaactgaagaaatggctggtgcaattcagcaagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340392 - DNA, 989 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgcaactgaagaaatggctggtgcaattcagcaaggtaaaagattatcttacccccagctggttaaaggcagaagctatgaatttgtgctattgtctgtgggctcctttcagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagataaaaacacgatgcggcaggtttttttcgcgcgcgggttggcgtgaggatgcag

SEQ ID NO: 340393 - DNA, 1272 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgcaactgaagaaatggctggtgcaattcagcaagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340394 - DNA, 1492 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaggtggttacaagaagaaataaaatgttggctggcagaagcagcagggaagatttcatattgaagactaactagttctgagacgttttggatgtcttcttgcaaacaaaatagaatgcaactgaagaaatggctggtgcaattcagcaagctttctgtttttctcatgcatgagaaaaatgcatttcagctgaaaacagtattatgaaggagaagtacttcaaaataaaacactttactcaacccaaaagactcactataagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340395 - DNA, 824 bp, Homo sapiens
ataaatggcggagacttttccctaaatgggttacttgatttaagagctgctggctaattttggtcggataatttaatagaagagggaagaggaaaggaaagaaaggggcttgaagaaagaggaagagaaaagaaacacaaggatggagaacaaggagagaccatttgttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340396 - DNA, 711 bp, Homo sapiens
attgatcaataggtagtgcctaaattccgacaagaagacttatggtcacaatacttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340397 - DNA, 708 bp, Homo sapiens
  misc_feature (28)..(28): n is a, c, g, or t
atatcaccaaccatcacaatatcctgtncggtcacaaccttattgattccattctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagcactgtcaatga

SEQ ID NO: 340398 - DNA, 184 bp, Homo sapiens
agaattcctggccaaagcaaataatgttgctgattcctctgagttctccttctccttggggatgcagttaacaccaaagggaactaggagtatgaacaattttgctcattcaagcaggatgacctgcttttacaaaacatagtcttcaggatggctaggtgcgctcaggcctataatcctagtg

SEQ ID NO: 340399 - DNA, 488 bp, Homo sapiens
ctgtcgtgctgcaatgtggaatgcggtctctgtgtggtatgctggtctgcaggcttttgctgaatgcaatgccaaagcatcaaaatctagaacagggcaggagccttgccaggaactgcttcaaggcaggagcagactgaaactggaagaaggttgcagacacatcttttgaggtgcagaaagctggggacaggactggaggggcaaaagcatttcctagcaatccacaaagctggcagattggttgaaaatcaggaaaagagattcctatgatttggaaagttgatatctgggccccaaggcacaaggagagtcctggaatctcactggtgctcagatcacaggacatgctaaaggagaggtcctgatctcaccctcaaaatgttccagtcaaatgatgaactcaatctaaagcccaggcccaactcaactactgagtggatggattctccccacaccaactccccacaccatggtcgggcaggagc

SEQ ID NO: 340400 - DNA, 218 bp, Homo sapiens
gtcaggaaggagaacctgaggagggtgtgtgggaagaatggagaaattcaggctgggtgtggtggcttacacctgtaaccccagaactttgggaggccaaggcaggaaatgagagaaaaatattgagagaggaaaaccaggtggtaagaaaactctaaaggtggccgggcgtggtggctcacacccatgatcccagcaggagtttgagaccagcctgg

SEQ ID NO: 340401 - DNA, 524 bp, Homo sapiens
agacggggtttcaccatgttggccaggctggtctcaaactcctgacctcagatgatccacctgccttggcctcccaaagtgctggattacaggcatgagccactgtacccggcctctttcagaaattttctttgtgtatataggccaagatatatggcaattttaaacctacatacataaatacagatgggaatatgttacatatactgagctaaattttcttttctgtatttaaccatagcttaacatctttccgtatcagcttatgtagctagataatattcttttgtgtagatgtgttgtcagagacattatttaactttttcctttaaactttttcctgtaaaactgaaatttaataagctaattttggtgaaagcctctggttatctatggtagttttctttattagcttatttagaatatcaatagagaacagtatatatattgaaaaactattagacctagttttttgtttgctattacagaaactactttgaatattctgttgatgtttggagcag

SEQ ID NO: 340402 - DNA, 333 bp, Homo sapiens
gaaggtgtcattttcctctggctgcttccagtagtctttttctgttgttagttttcagggtggatgggcaggggcagagaagaaagtgtaattatgacatgtcttggcatggatttctgtgggtttatcctgttttgatttactcagctttttgcttctgtaggtttctatctcttgccaagtaggaaagttttcagtccttatttctttgaatgccttttcacctgctctcttttctttctttcttgacatccagtgacatgaatgttagatcttttgcagtaccccaggtactacatttccatgtattttctttcttttgttcatttgggt

SEQ ID NO: 340403 - DNA, 262 bp, Homo sapiens
agacagggtttcaccatgttggccaggctggtctcaaactcctagcttcaagtgatccagctgccttggcctcccaaagtgctgggattacaggcatgaaccaccgtcccaccattggtggttttttttggtttgttttgttttttagtacttttctctttaatttttttggaatagtatatttagtttaataaccaaatttaccccataatttagtcagcaacagcactccagcctgggtgacagagcaagactctgtctc

SEQ ID NO: 340404 - DNA, 810 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcggtgagtccctggagccccccacagctccgccccggtgctccgcacccagcttcggtcccctgggaagcctccgggtgcctagtcacggaggcagggagggcaaggaggctggcgtgtagctctccgacctggctccgcccagctttcctcccactcttgattgacaagaacttgggccattaggaagccttggcttgtgatagatgtatatgacagccagtaggtaaggagagagggtgggtccggatgcccacggcgcagccaatgtgcgtctgctggggtccccaatcgagggagaaagttttcgtggttaaagggactgcgtggttggcagtggctgggccactctgctgggtcccgccgcctgggctctggccagctccttcctggctcaccgggccctccggacacagacacctgagaagggctagaagtcccttctcccaggaccgcgaagccccgggcttggcgtcttggggccaactggccagaggggcccagcgccggacagcccgcggccaggcctcacagacccgggtctcaggacgtgtccgcctgggctcttttctcgacccaacctcaaatggacccgcacagactctcagaacctgagcagacagtggtcggacaaaccctcctggtcagcccatctcggtgctccgtaggtggggcagccg

SEQ ID NO: 340405 - DNA, 2728 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaaaaaaaaaaacacaaaaaaaagaaaacaaaaaaaagagacaagacaaaaaaaaaccgcgggggaatattccgacggccgacaaaaacagcggccaccaaaagggccacacggtgaccaccggtgcacacacccactttatagcaccagagcgggaacagccgcgggcccccaatagggcggcccgaaaacaaccgcaacccgcggggcaccacgtaataaccatgcagcgaaggaaagccagagcatgacgcaacagccgaggcgcagacacagcgaagcgcaccagacacggacgcacaagaagcagcaaaaacaaaagaggagcgcgacagaccgcacgacccgcgcgacgcacaccccacacacgcaacagcagcacccac

SEQ ID NO: 340406 - DNA, 2266 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaagggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340407 - DNA, 2315 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggcgctgaactgacaattaacagcccattatctacaatcaaccaacaagtcattattaccctcactgtctacccatcacaggcatgctcatatggaaaggttaaatgaaaatattataaactttagggggggcccggtaccttatttcccctattgtgggtcgttttacaatttattggccgtcgttttccaccggcatgactggtaaatctcctggtctttcccaccttaatttgcttgcagcccattccc

SEQ ID NO: 340408 - DNA, 1396 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgtcacctcttggttgatcctcttgtactgggagaggtgccttttgtatccccaattaaaggtagaaaaccaccctgctagcagcattgtcaa

SEQ ID NO: 340409 - DNA, 980 bp, Homo sapiens
tctagaggatcctccggaatacacagcgaccagcgaagggtatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340410 - DNA, 1336 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340411 - DNA, 648 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccaggtgagtgccaggacagggcagggcacggccaggaagagctgtcagtgcaggagcttcctgcccagtggagagtcgaggccatcgtgtttgtcccaggctccgcttctcatttcggggcgtctcggttgtcggctggtgggatgttctgtggggagggaggcttgccaactgcgtgctttgctgtggagtgggcagggcaga

SEQ ID NO: 340412 - DNA, 2345 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340413 - DNA, 2545 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacgagacaggggtctcactgtgttgcccaggctagtctcaaactcttggcctcaagcagtcctccctccttggcctccgaaagcattggtattacaggcatgagccaccacacccacctgcccaccttgtatcattctgttcaagagtcacatccccaagagagacttggattggctgagcttcattgtgcctaccagctggggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340414 - DNA, 2031 bp, Homo sapiens
gaagtgcctaagggggtcaccagcgaagaatttgacaaagttcctggaacgaacgggccaaagccgcggaccgagttgcccaacctctccagcccctcagctgaggggcccccgggtcccccatctggcccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340415 - DNA, 1686 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340416 - DNA, 1440 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagagtaaaatacgaagccccccaagtgaggccgagccggcagctgacctgatcgacatgggccctgacccagcagccaccggcaacctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340417 - DNA, 1135 bp, Homo sapiens
agtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 340418 - DNA, 419 bp, Homo sapiens
cgtggggaataagaacttccacgaggtgatgctggctctcacagtgagtgccccatctgtctgtcctgtggcaggactacggtccactgaaagtcacctcccctcagacccagcaggactcccagcctcctctgagctcctcatttgagagctggaaaggtctgtaggcaacgcactgtcctgtctacactgcaggcggatgcagaatggcaagaggccatttggaaaggttctccccaatcccccagcatgggaacagacgcttacatcactccagaaccactggcagggagagcctgggccaaaggacctgtgggtgacattgaagctcagtaaacccaggcctccgcgggggcagggaggccggctgactgagttgggtgctgctcggcactttggtgctctggcaaatgaatgta

SEQ ID NO: 340419 - DNA, 227 bp, Homo sapiens
agcagttgtaggtcaggaggagagggaaccatggtcctgctgataagttgcctgtctgtattcaaaagggaggagaagaatgaggaaggatttggactggtgacagagagctggcagtggccaaggcatactgggggtcactgagcagcttaggttccatggaagaggagcagtaggagtcaaggttgtaaacacatggcgaggcctgctgggcaggagcttagcag

SEQ ID NO: 340420 - DNA, 439 bp, Homo sapiens
gctcagatacctgctcgccattaccagatctacccctcaaagcataatgtctgctggtgggaggatgagtagcttcagtgttttgtacaaaggagagtatatttatttctaatttcagagtttctcttgctcctgtctagacacttcagagagaaacaaattcaggtcaccagtaaagttatgttctataataagagaagactcgtgctaaatcacttgtaaagacattaactatcatctgcctgaaaagtcttctctcaccaagcttctgcagatcttttgaggtaccagaaatagtggttagttctcacatgctgttctgcttcagcgagcttcatgtggccacctgcagaaatagttcttggtttctcttccttgtctagatgctggtcaaggcagcgtttagaaaaacacagattttcatattcccattcacacg

SEQ ID NO: 340421 - DNA, 385 bp, Homo sapiens
cctgggaggtccaggttgcagtgagctgtgattgcaccactgtactccagcctgtggtgacagaacaagaccttgtctcaaaaaaataaataaacaaataaataaacaagaaaaacaaggaaaggtaaggtgtaacttaacctactgtaactcacttgtgcctacaggaaaaaaataaaatagaaaaaaaaagagaaagagataagaaaactagaacatgagacagagtggagcaacgccaggtaaggggcagtaagaagtgcaggatattggaaggagccatcactcacgcatgtgactgtcacggaaggggactgcttccctctctgctgaaagaaaggtgatggcagaattcttctcatactaggggctgggttctgaaggt

SEQ ID NO: 340422 - DNA, 539 bp, Homo sapiens
  misc_feature (32)..(32): n is a, c, g, or t
acgctgcaccgcgcgtatacaggcttcgcagncgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgaaccggcgtgcgcgtgaggtaccgagctcga

SEQ ID NO: 340423 - DNA, 7350 bp, Homo sapiens
ctgtgctgttatattttttaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340424 - DNA, 7627 bp, Homo sapiens
ctgtgctgttatattttttaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcaggtagaagtctaaagctcatgttcctgcagtgtggttaccatttttaactgggagtctcactggcttgctgaaaatgactcccctttcccttccaagtccctattcctctcgatttccttttcctagaagcttttctgctttatctcatctgtagcttgcttccttccagagggctatttagtcgtttggctgatttcctgggccatgtgagatgagaagatgaaatgctgtccctgtgtttagcccgtggctttccttattcagtgtctccttgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340425 - DNA, 4720 bp, Homo sapiens
  misc_feature (32)..(32): n is a, c, g, or t
acgctgcaccgcgcgtatacaggcttcgcagncgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340426 - DNA, 6454 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340427 - DNA, 6315 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatcta

SEQ ID NO: 340428 - DNA, 5075 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgaaatgcatcaaggaccattatagaaaggatcccctgacctaaggatgaaatcgacctagggttaatcatgacagctgcatcagttgtattggatgcaagtcaactctggagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatcta

SEQ ID NO: 340429 - DNA, 2306 bp, Homo sapiens
agcatgatttccagagaggagtactggggaagcttgatccatgaacatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340430 - DNA, 4590 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggtaccgccctcccctggccatgtcccaagtagggacacactagcctttctctgtttggaactggggctgccaggccccatgtgaagggagaacaatgaacaggagccccacgtgccaaaactcagacatcattgaggattagggcccggcaggaaccagccatacaggcctgctgttagatactttctcatatcttaaaagaagctgaaaatccagaatgcttcaaatcttctaacttttaaatgcagaaaaatggtta

SEQ ID NO: 340431 - DNA, 3534 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaaggtcagtgcctgcacctgccctggccctgcaggaagagagaggtgacctgcaagacaccagggccagaatccacgggcagcgtccttgggcagccccgccaggaagatgccaccccacctcaacctttcatgtagcaggcagggctcctctggagcaacaggcccacccaagggaagttactttaattataaaagtaacatgctctgaaaaataaaattatttttaaggttttcaaattaattagaaatcatatatgaaggtctgtttactatctggcctccacatccctacatcccagaagtgacattgttaacagatgagtctctctccttccagacttttctcttgacatataaacagacacatgtgtgcacacacacagctttttgtc

SEQ ID NO: 340432 - DNA, 2849 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtaagagggttacccctcgactcagttggcaccttgcatagaaa

SEQ ID NO: 340433 - DNA, 2490 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgaaccggcgtgcgcgtgaggtaccgagctcga

SEQ ID NO: 340434 - DNA, 6671 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340435 - DNA, 6532 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatcta

SEQ ID NO: 340436 - DNA, 5431 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340437 - DNA, 5214 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgaaatgcatcaaggaccattatagaaaggatcccctgacctaaggatgaaatcgacctagggttaatcatgacagctgcatcagttgtattggatgcaagtcaactctggagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340438 - DNA, 2544 bp, Homo sapiens
  misc_feature (4)..(4): n is a, c, g, or t
tgtncacgctgccaggtgagtgccaagctgaagttgaagctgacggcctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtctctt

SEQ ID NO: 340439 - DNA, 4071 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcgtgagtgcaaggcacagttctggggggctgcagaacccggggcctccccgccaccttgcttaggcctccatgcagacccgagctccccgctgaggctgggttgggatcccacagaggaccttaggggtgtgagccatgtgccaggaaggcttatttcatggggacagaggcctctggcctccctccctgctggcagcagagattggaggtgacatgaccagccctgctggccctcccctcccacattggtgctcattgcctggccatgggcaagggctcctggagctgagtgaacaggcactgggagaacagctgtaggggtgaag

SEQ ID NO: 340440 - DNA, 2625 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcaggactgcattaagtgagaagaagcatcttcagaatcaaatcagggccgagcc

SEQ ID NO: 340441 - DNA, 554 bp, Homo sapiens
gttctagaggatcccgcctaagtggaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcccggcagttccactataggcgggatactctagagtc

SEQ ID NO: 340442 - DNA, 174 bp, Homo sapiens
tgtattcttagtaacactttatagcagatatacattttatcccacaactctgggtgtgagaaatgttgccaccttctatttgtctaaatttgatttcatctacttcacactacctcttcctccctctacccacacacagaccagatttggggaaggccttgggaacatttggga

SEQ ID NO: 340443 - DNA, 185 bp, Homo sapiens
ggaggtgcatgccactgtttggatagccagatacttaaagcaagtaggcactctttttatgtcccccggagacttacaaagaaccaataccagcccctagatgataaatttgatggattcttggtattttgagggagaatcattgggaaacctttgccagtccccaggagcctgagcactgcatt

SEQ ID NO: 340444 - DNA, 464 bp, Homo sapiens
tcacctattagctgccagagaacaagaacccctatctgttttgccaatataaaacctacactttgaacaatgcctaacacacagcaggaatttgaattattgaacaaacaaatgacataaccctgagcctataaacacagcactaaaaattatattcctttccagagcaccaaatgcaaaggtttcaacgatagttcagttaacaatcaccctgacgagactcagaaggacaaactgaaaacttctgaaatcaggtatgccaactagaaaagaagttttacttcagcagttcatttctacttccactataaagttatcttcaataaaatttcatagaaaaagtatattctgccatgttatttttcttgaaaagatgttatgcacttgtagtaacaagtatgtaataatttatagtgtaaaagattaaatattaaatagaaaaggaatcactgatagggtgctac

SEQ ID NO: 340445 - DNA, 243 bp, Homo sapiens
aatcaaggtgtcagctggggctggggtctcctctgaaggctcaactggggaaggatctgcttccaagctcaatcagcattttttggccagattcagccctgcactggctgttggactggagcctcagtttccttggggcagttggccagaggttgccctcagttccttggcatggggcccttccaacatagcaacttgcttcatcaaagtatgcaagtcaagatagcaatagaaagagtcacc

SEQ ID NO: 340446 - DNA, 562 bp, Homo sapiens
tgctgggattacaggcgtgagccactgcgcctggcccctttttcttcttaacacactctcatggtattatgacttggaatggtcttttgaggttaatttgataatataggaaaacccaattgttggcccaaatttataaccgtttacactagtagttgatcatgttgacataatagtactaagtggcagaatctttgttaatatttgtgattctctttttggttatggatcaaaaacctcccaagagtccacataagagtacttttcatgctagtcaaaaattcagttctaaagcatttcattattttggaaaaggcagtctgttatacatctgtagtcaaaaagcagtgtatagctttcaaattttctgaaacattatcagtggccttagagtaagattctggtgttgttaaaggcttcttgatgctttgtaaggtcaacattttatgaataattttcttttgtagttttaaggggaaaagactagtggatcaaaactgattgctcatacattacaacttcccaagtcattgtgtatctgaattggcagcctagagtaaat

SEQ ID NO: 340447 - DNA, 212 bp, Homo sapiens
ctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgttttttttttttttttttttttgaaacaaagtcttgctctgttgccc

SEQ ID NO: 340448 - DNA, 406 bp, Homo sapiens
agtaaaggcaggaaggggaggacaccaaaagcatccatatattggactatgtttgcttcctactcagtcagcacaggccgcagtgtttgaggacatgcagtcaggtctgtgggcgtgatctctctctacaccgaaggaatgagcttcatcagcaccattccatcgaagggaattttgtgctgtatgttcccagggtcactcacaaacatccctacttacaagtgacttgatgctttccaaaataacagtttattgggattttggtttaagtttgcactaattcaaagcctgcagactgcagtatacttacacacctttattgtacttatgagtgtagaaactgtgatacggctgattcacttattcatttactaacatatagtgaggggtgtgtgtgtgtgtctgt

SEQ ID NO: 340449 - DNA, 545 bp, Homo sapiens
atgctggttctcctgtagctgctcctctttaggtgaccctggtgagtgatggtggtttggggactatgatggaagctatgacccacttcatttaaaatcatccctgaagattggccagaaccattctggattcatttctgagtgagacacatggcggctgccctattttcttccctaggccttggatctgaggcctctttttgaatcctgtcagccctgtcagcatttagaattcctaattatttttctaaaataaactctgagtcaagaggatctctcttccctctacatttccttctaacatcaattttctaaaattccaagagtagtctgtctcacctctgtcctcagattctgttttctacatgtggcaatggcaatgtctgtgcattttacacagctccttggagaacttccgcccatcttttctattagtttgttcattctgggagtatggaggaaaggggctgggccaagctggctttcagagtggggagagtacttctttctcatggtgaaattgcagggtgtgtgtgtgacggggt

SEQ ID NO: 340450 - DNA, 355 bp, Homo sapiens
gctatgaagtttacatgagaatgaggaagaaatggagatgataaaaatgaaggggagagaaagagatctcattcttaaaatttacatttaaaatatccccaattctaaaaggttttggtgggctactaagcatgggataaagggctattcttcagggtacccacccctttctctgtcctttagcctggtgctcagagcccttacgttatcaagatttgcatatacaattgaactaataagtttcctagggctgccttaaaaatttctacaaaacaggtagctaaaataacaggaatttttggtctcacggttgtggaagccagaagtcctaaatcaaggtgttggcaggactcgg

SEQ ID NO: 340451 - DNA, 345 bp, Homo sapiens
cctttaggccagagtttatattgggagtcatttatatgggtatagttatccacccacatggctgatcttcagtctccagtccctctagtggtcacattgatactgtctggcccaatgtcagacataatggaattatttgcatagattttctggccccaaggcttctaggtaaacagacactgttatcagggaggatattctaagggcttagaggttacctccagagtaagggtcatcctttctttggattgtgcaggatgtgaacaatctgctgagctgatcctttactatacagtttcattggggccacctataattcttaacttaaaaaactatttcattcaa

SEQ ID NO: 340452 - DNA, 550 bp, Homo sapiens
catacatgattaaagtgagaacaaacatgtgtttgcaaatgcttcaagttcctaaagaagacttcgcaaaagaattgagactttaactggtattaaatatttaaaggcaaaaagcaacagagaaagtgcactttaagcagctaagtaacaaaccaaaacagagcacagatgggagaagaatgaggaaggtaaaaatctagaacgttagattgaggtcaggagcagaaagccagaagtggacattagccagttggtagtgcgggacttctaagaattgtaaacaggaaagttattatgaaagacacattttaggacttatcacgttagagtgatattattctaaatttttttttaggaggattcatctggcgactcagcaggttagtgaagaaaaagttagaagaatattaccctaaatcacggtcaggtgataagggtctgcattatgacagctggaactgaagtgaatgacataaatgtgagcaccacaaaggaagtctcatcggggcttggctgaatataaagagagggaggaattaaaatgtgttct

SEQ ID NO: 340453 - DNA, 639 bp, Homo sapiens
tacaggcatgagccaccacgcccagccgatttaatttttaaaaagagactttccaagaagctttttaaaaagatttaactcaaaaagcaaggatatttttctactagtagtttcagaaagtgctaaaattgcaatgccttatgaagtttcaggttaattgatctggttcccccccacatctgtgcacaggattccagttaaaatatgtaaatcagcaagatcctctggttgcaaagatctagaatgattctgttaatacagtccttcccgctgtttgcatgtgtagccaccgtttctagactatactgttaataccttttttttctttttataactatgccttaaacttgcaatctgccacaagtgagctcaagaaaagaaaacttgtcacatgtattgttttcccatagcccacagctatgctgatttgtttgaagttgtgaattctttggtctggaaagcaaaactttcgctattctatttgtggttgtccttcattattctatctgtattctaactgtctggctagtaagctgtcacttttcgttgcacatgttccgtgtgttattttgacagaactcattcatactacttgctttcatcagtttcattattgcaaaattgaaaagttgggccctg

SEQ ID NO: 340454 - DNA, 947 bp, Homo sapiens
cgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagccagaagcgctgggtgagcctttggaccaaggcaggtgggcaaaattcaggttcacccagtgttaaagccaaagtcccctccagagagagcccatttttcactggggcgcaaatcccttcttggaaagaccctcgcgcctctttagttctcaaggcatgttga

SEQ ID NO: 340455 - DNA, 1174 bp, Homo sapiens
cgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccgg

SEQ ID NO: 340456 - DNA, 1404 bp, Homo sapiens
cgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggttcagtgaaacaactcctgctcaaacaactggattcaaaaagtgatgttcagtagatggcatctttggaaacaggcatgatgacccatgaagtgtacacgcttgggttactgcagagaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccgg

SEQ ID NO: 340457 - DNA, 758 bp, Homo sapiens
tggtaagtcattaatcactttaagctatttccaaaaataattcctttaatagagttgttttaagaattaagtggattatgtatgtaaagcactttagcatgatgcctggcacatggttagtattcactaaattagctacactcattattagccttgccaagtggagtttgtaaaaaaccagctttgaatctttagcttcctaggtccttttgaatgaatcagcttgtactattgttaatggtttcattttattgctgaatttcttgaatacagttatgctaaatttaaaaaattatattcttaaatataaatgaatttaagttgttcttctgttttcaattatttaggtatattttttaattggaggggatgatcaggttgactggactctataaagagccagatttgaccagaaggttattttaagataatacagtactgctataatcactagaccaaaaaaaaaatctctaggaaatttaattttggctttgagtcatcttttaagattaatttttttattttaatttttattattacctcagtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccgg

SEQ ID NO: 340458 - DNA, 1283 bp, Homo sapiens
cgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccgg

SEQ ID NO: 340459 - DNA, 120 bp, Homo sapiens
tggaggctatctgagaccttctcagagagggctgctacttgagctcacctttgggaacggatggggcataccagcagaagacaagtgctggagaaaacacaaggcctggggagctagcca

SEQ ID NO: 340460 - DNA, 655 bp, Homo sapiens
tgattttctccagaaaactggttcagcagaaaccaagacactgccaacagccctccggcgtcctgccaaccgggctgttagagtctttatgtgggtaggtacaagttgccttgcttagcttccaaacttatttttgccctcttgtctggctcctaaaatgctggatccaggggcctggagagttggttttgtctctggttattgtttagtggcacacaaggtactgactgaaaacaagggcgtttttgtacatcccttttacccacatgcactcttggggaggtcagtgatggttggaagtccctgctggcaccgtctctgccatagcattgggggagcactttagttgtccgtttttccaggctaatccattccttaatgacttaagttgacatttgttgaattatggagtacgagttcgctagcactgctataacaaagtaccacaaactgggtggcttgaagaatctcagtgtatggtctcagctctggagaccagctgtctgagatcaaggtgtcttcagggttggttccttccaagggttgtgaggaaaagctggtcctgtgcttctctcctggctcctggaggtttgctggtaatctgtggcattccttggtttatagatacattgcctctgtctctgcggtcatcttc

SEQ ID NO: 340461 - DNA, 592 bp, Homo sapiens
atcatttcaaggattcatgtcatatcctcttgtgttaggatctcagaagcaggagttccatgggcccacatttcttggtttattccctttctttattggattctaccttttagtagcttcctgaaaagcgtgcatgggaatgaaatttgagtctctactaatctaaaaatgtttttttttttgtactttcaagcttcttttataacttaacccagcagaattctaggttgaaaattacatttctaagggctttgtttcatcctttttcagcctccaatgttcttgctgtcaagaaatccagtatgctggatgccatacctgtttttctttagaagcttttaggatcttctcctgatctctgatgttcagacagaaacttcacaatgtggctaggtatgagtccctttacatttgtagtacttgctgggtacactgctcggactctgaaatgttgttataatttttgaatattaagaaagaagtgtttcttttctctttctggaacatttattatttagatatttagctcctggagtgatctatctgttttgctcttgattcatttgttctattttttttttttttttttttt

SEQ ID NO: 340462 - DNA, 946 bp, Homo sapiens
ataaggctccgatattcgacctatccatgtgctgggtaggtaaggcacctgctggacatgggttcccgggccagatgagaacacttagaccaggtgaaagtacttgggtcatgtgactgtagccagctcaggtaaaggtattatggttcaggtgagggtgtacaagtcaggtaaataggagtatctggatcatgagaggaagtgagcgggtgtgtatctgaactctatgagtttgtacaggaaggcaggtgagggtgtacctggtagaagggtgaatgtgcaagccggttgagctggcctgcggtcagagttctctgggtctagtggggatacctgtctcagtgaaaacatttaaggtgatggtatacaggtcacctgagagggcatacctgccacacagacctgtccaaagcaggtgggtggatcaggtgaaggtacccaataatgtgtgtctggtatgtgaagttgtacagatcatgtgaggaggcacctgccacataaacttgtccaaggtaggtgagggtgtccaggccatatgagactatccatccaggtaaagatggtatataggtgatctcagtgtgtacctgccacacataggcctctctaaggtgagggtagggtgagttactgggctaggtgactctctgggacatgagatatgggtcaagtgagtgtgtacctggcccgcccaggtacaggtgacggtaaacaggccaagtctgggtgtacctgtggacaggagagtccaggctaggtgattagagtacacgtaggttcagggctgtctggggcagaagaggatgtgtctgttggtggaggtgcccagctgtctatgccaagcatgaatgcacgggtcaggtgatgtatccctgtagagagcatgtacctatggactaggctgcctgggccaggtgagagtgtacctgtggacaggtgtgtctgg

SEQ ID NO: 340463 - DNA, 319 bp, Homo sapiens
actctgtctcaaaaaaacaaaaaagaaaaacaaaaaagaaacgaggtcagatgggaatgtgttggttggttggttggctagaaaagggtgtttgggtcagtgaacaggtgctgggtaggtaaggcacctgctggacatgggttcccgggccagatgagaacacttagaccaggtgaaagtacttgggtcatgtgactgtagccagctcaggtaaaggtattatggttcaggtgagggtgtacaagtcaggtaaataggagtatctggatcatgagaggaagtgagcgggtgtgtatctgaactctatgagtttgtacag

SEQ ID NO: 340464 - DNA, 210 bp, Homo sapiens
gtgatcaccaggaaggaagaaaggaagatgtttacagtaagtgggagaccagcatgagtctgcagtctccctcagaccaagtccacaacagtttacccctcagagggggcttacacagtcaaactggagagaagtagaagcatgcttgaaggaatatgaacagctagtccttcagataagaaagattcaccaataaattctaattaccat

SEQ ID NO: 340465 - DNA, 598 bp, Homo sapiens
tcattttgaggaatactggagagaggctccttttttcctagcagccaaattgttttgagactattgctgtgacctggagacatgagatatatttactgactcatcttgcacaagtactacaacaatgtgggttaaatacaattctctagattctagccaccatttacatcacttttcacccggaagaatgtattgtgtctttcaaatatctgacttataagatgacttttgcaatatcatcttttgtaaattgagggtggcctgtaacttggttgccttagcaacaaattggactgaatgttaacagttgagtccagatgttcattccaggcagacaagaaaacacagcctggtccactttgaaatgcactcatcagtactgcccacatcagtgtttgacatggttctcagatgcctcatgttgtctttaacccaactcggagccatgggcattacccgtgccagattacattttttctttttactaaagagacagcaatgtggagtaaaactgatcattgatttttaaggcaaaactattccagtgtctaattcagggacatcatttaaaaaatcatatgggacttccatatgactt

SEQ ID NO: 340466 - DNA, 435 bp, Homo sapiens
ctccctcattagacactcatttgagcagtaccacctctatttcctgcagcgtcctaggaatagatctgctgtgctggttaccactggcactggtagggctgcatttgcattttaccagttatgtcatggccaaaagttgccttcaggctctgctccttgagatttggcattgatgttgggattttgctggaggccttctgcccactcccaagcataggcagctctgtaagagtcctcagccttttattttatccagtgttctgggtgtagttcatagtctttgaatttttgttttgcctttgggtgccatgcttccttagtttcaagtggtgatacatgtttctctcaatcccatttttcacccttcattttgatgacgttgttaaagggacaagtttaatgtgtggtttttttgttttgttttgttttggtttt

SEQ ID NO: 340467 - DNA, 281 bp, Homo sapiens
ctgtgaatccttagacgattcactctgagtccctgggatcagcctcgggccttccagggtgtgcggaggtcatgcatgaagtgtggctcagccagctctggcctttctctcactcttggccctctcagactctctattccacttgtcattctctgagcactccctacattgtttcctgattacgtgcctttgctcactctggcttgtacttttgctgggcatcagcccttcctgccccaccttcctcttttgtgtctgttctgtgtcagttaactgtgtat

SEQ ID NO: 340468 - DNA, 229 bp, Homo sapiens
acacacacacacacacacacacgcaaccatttcagacactgcatcttaaaatttgtggaccaaagatttttcactttttacctagtgactgttactagcattctgaatagcagagaaacaggaagattttatagaaaactttaaaatgattttctttaaaggtaaacctcagcattaattacctgcaagtgcagaatctcatgcctcttttatttagttagcttttttt

SEQ ID NO: 340469 - DNA, 349 bp, Homo sapiens
tccatttcaaaaaaaaaaaaaccagtaaaagggtaacatatataaaaagttcactacagtccccaacatgggttactatttaatcagtagcagataatgttattaggcaatgagtaacaggcttctgaggatggctaacttaacaatgttggatagagaggagacacctgagggagcgaaagcaggctattgtgataccaagcaaaaagtaatagcaaaggagaaaaaaggaaataatcattgaaactaggatgggagctggtgctaggatgaatgagaagagagggagggatgaatgaatgactacacagacagaaaacaggggctgttaactgagaggaagagaaag

SEQ ID NO: 340470 - DNA, 276 bp, Homo sapiens
ggcagtactaaatgagcacactgaatcatagcagctaagagaataccatgtccaaaagcaggctgaatttctgggacagagctcatcagtttcttcttttattctgcccattattggttctacctgcccatgctctttgctttcattatgcagaatcaacactgggaaagcctaagtcctgcacctctgccagaggctcaaagggccaagtcaaataccctgtgaaaagccctataggcacctgatcacagggaacacacaaagatgcagggcagt

SEQ ID NO: 340471 - DNA, 511 bp, Homo sapiens
cccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgtatgggaagacccgctctcgcatacccttggtccgtaaccgtcggttccagttatgccgttgcttgaacccgagggccaggaa

SEQ ID NO: 340472 - DNA, 425 bp, Homo sapiens
cccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgggaggaggacaccccagagagcacctccaatcctgttctttctaaaaagaggaaacttccaataaccacacttttccaatgggaaagatacgcccccagtgggtgagctctccacgcaggaggactcagaagtgatcactcatgagggacacttaggacacgatagaggactaggctagacttgataaaggttggcacttgggatg

SEQ ID NO: 340473 - DNA, 986 bp, Homo sapiens
ggctgaggcaggaggagcacttcagcccaggaggttgaggctgcagtgagtcgtgatcacaccactgcactccagcctgggtgacacagtgagattctgtctcaaaataataacaataaatatctataaaataaagataatgatatctttattttatagataagaaaaatgaggcactgaaaaaattaagtagtttgagttttcacaggtaggaaaatgacagagctatgatttgaataaggcagttcggtgctagaatccatgtacttaaccacaatgcctgaagcataattctgaactgggcaatcaaaaggggatcacccacatttcactgtgtgaagcatgaattgcctgatagaggaaattttttttggttctaaattcagggagaaggctgttaagcccaggcctctgtgggggatgggagttctttgttctgtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggtgggtgacctgtgactgtacagctggatgaatgacgagcagaagtttaccacataaagatggtaaggagggaatttctgggcagagggaacagcatgtacagagaggcccagaggactgggaaagtgtgctgaattaagagaggtgcataacactagtccatatgttagctgtcgtgtatggcagaaggcgagacaagcctggggagattagcaggggcctgttatgaagatacttcattgctgcactgttgaactttaggatcaggaa

SEQ ID NO: 340474 - DNA, 1553 bp, Homo sapiens
ggctgaggcaggaggagcacttcagcccaggaggttgaggctgcagtgagtcgtgatcacaccactgcactccagcctgggtgacacagtgagattctgtctcaaaataataacaataaatatctataaaataaagataatgatatctttattttatagataagaaaaatgaggcactgaaaaaattaagtagtttgagttttcacaggtaggaaaatgacagagctatgatttgaataaggcagttcggtgctagaatccatgtacttaaccacaatgcctgaagcataattctgaactgggcaatcaaaaggggatcacccacatttcactgtgtgaagcatgaattgcctgatagaggaaattttttttggttctaaattcagggagaaggctgttaagcccaggcctctgtgggggatgggagttctttgttctgtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagttgtctgtttgttcttctgtcttcttcaacaagcttgccttcctacctaggtccaacctgttgcttccccagtatcactcctcagcccagttttctacccatggggcccatactatggaagatctagaagggatggccccgatcctcagctgcttccacctccatcttctccttctgttatggataatttgttttctcttttttcctaattgttctgttttatcaactttgttgatatttttaaagaatccatttttagacttcgttaatttttgctgttacttggattttatttcttttctctttttaatagttactattttcttctttttacttcgtattaacttagtcatctttttctagcttcccttttttagctgtaatacacggcagtgactaaatttt

SEQ ID NO: 340475 - DNA, 370 bp, Homo sapiens
ctagatgtagaatgagggaatactgatctccaaatgaggactgggtaatgaccattaacactagatgaggagctgtgtaggtgactggccacacacgtgggattaggtgagtaactgtccactctggatatggagcagactgagtgcctcatagcaaaccttgtgtatctgaaaaggcttcatgcctgagaatatctttatctacttcccaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggaga

SEQ ID NO: 340476 - DNA, 1357 bp, Homo sapiens
ggctgaggcaggaggagcacttcagcccaggaggttgaggctgcagtgagtcgtgatcacaccactgcactccagcctgggtgacacagtgagattctgtctcaaaataataacaataaatatctataaaataaagataatgatatctttattttatagataagaaaaatgaggcactgaaaaaattaagtagtttgagttttcacaggtaggaaaatgacagagctatgatttgaataaggcagttcggtgctagaatccatgtacttaaccacaatgcctgaagcataattctgaactgggcaatcaaaaggggatcacccacatttcactgtgtgaagcatgaattgcctgatagaggaaattttttttggttctaaattcagggagaaggctgttaagcccaggcctctgtgggggatgggagttctttgttctgtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagttgtctgtttgttcttctgtcttcttcaacaagcttgccttcctacctaggtccaacctgttgcttccccagtatcactcctcagcccagttttctacccatggggcccatactatggaagatctagaagggatggccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaacc

SEQ ID NO: 340477 - DNA, 1462 bp, Homo sapiens
ggctgaggcaggaggagcacttcagcccaggaggttgaggctgcagtgagtcgtgatcacaccactgcactccagcctgggtgacacagtgagattctgtctcaaaataataacaataaatatctataaaataaagataatgatatctttattttatagataagaaaaatgaggcactgaaaaaattaagtagtttgagttttcacaggtaggaaaatgacagagctatgatttgaataaggcagttcggtgctagaatccatgtacttaaccacaatgcctgaagcataattctgaactgggcaatcaaaaggggatcacccacatttcactgtgtgaagcatgaattgcctgatagaggaaattttttttggttctaaattcagggagaaggctgttaagcccaggcctctgtgggggatgggagttctttgttctgtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagttgtctgtttgttcttctgtcttcttcaacaagcttgccttcctacctaggtccaacctgttgcttccccagtatcactcctcagcccagttttctacccatggggcccatactatggaagatctagaagggatggccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaacc

SEQ ID NO: 340478 - DNA, 439 bp, Homo sapiens
cataaagaaatgggtaaccttggaaaggagaatattccacataagaacgttaaccttttaaaaattaagtcccggggcttcatgttaacagtgtgttaaatgtcgtttttccctcctcctttcacgttgcatgtggatgcagcagctgtgccttgagcagctactgagatcagacgcccctttcccacccagaccccagagctgccctagctttgcctctttggactggcccagttttccccaccagagtcattagtgatcattgtacttatcactctattcggggcctctcctgctacccttctcttcccactgagatctcttctcactgaccgtttccatctgttaccaaaccaatcaacattccttttccttttccaattggcaaacataaataggttttatttttattttgaaatggagtcttgttctgtcaccc

SEQ ID NO: 340479 - DNA, 112 bp, Homo sapiens
acaaatcaatgagtttagtaaaatcaggataaaagctcaatatacagaaaacaattgtatttctaaatcctaggaacaaataatccagaaatgaaattaagaaaacagtccc

SEQ ID NO: 340480 - DNA, 298 bp, Homo sapiens
agtagtagattgggggtgaggaatgaatatagtcaactataaaatagcatatctgaacagcattagtataaaaatgtagtccttcatatacctttttaatgtaacttgtttattggtaaaattaagaaggaggtgtatatagaggcttagttattatgcaacacataatcttcaagaagctgaacaagggaaatgatacaccaggtttattacaggaaagtgtatacgctacacttcatccaccattagggtgagtgtcaggctaaccagcagaatcagtggaaagacaagaacaagc

SEQ ID NO: 340481 - DNA, 464 bp, Homo sapiens
gggatgatggtatgtcagcctgaacccaaagccatctctttgagatttacccatttttcccttggtagatggggaaaccatgtatatatacaaggtatgcatgtggataaacttctatttcttttttctcttgttaatctactttttgttacaggggtagctttcaactaagaacaatgaagggtggggagaaaactaggtttcctcactgatatggtttgcctgtgtccccacccaaatcccatcttgaattgtagctcccataattcccacgtgttgttggagggacccagtgggagataactgaatcatgggggtggtttccctgttgtgaataagatctgatggttttataaggggaaactcctttcgcttggttctcattctctcttgtctgctgccatgtaagacttgccttttgccttctgccatgacggtgaggcctccccagccacttggaactg

SEQ ID NO: 340482 - DNA, 353 bp, Homo sapiens
tgttaacagtttactgtgtttactttctcttttagccaaagaaaaagaacaaaaactgttcttctcatcaatgcttgatatcgtcaatatgttttatttaaggtgctctggtcagtgtgcagggctgtttcactgtgtttttcagtcatcatttttaaacgtttgtctgataactctaatatctggccaccatgttgatctgtttctgttgttcttggctttcagtcatgtcttgttttctcacatgcctggttagttttggctgactagcagacattttatgtgaaaaattgtggaggttgagatctagatagtgtgatgtgtctctggaaaggatttacctttgcttctag

SEQ ID NO: 340483 - DNA, 172 bp, Homo sapiens
tcagaatttatcttgtatcttctttaatactaccaacaatacattttagttgaatattttctaattcaaaataattactaaatgtttgttgtttactcaaatgtcattcatattataaatagtatgggtcttggtggacaaccggaccatgaaaagcatcaaacatgcagat

SEQ ID NO: 340484 - DNA, 597 bp, Homo sapiens
ttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtaaatcaactggtcttttgtgagatttcttttaattttcctttatgtaagagaggaactgactttattgtgactatgcctcttttttccttggagaacaagaaagcttttttaaa

SEQ ID NO: 340485 - DNA, 715 bp, Homo sapiens
ctcatgtaagaggtgatgttaaaggatctaattgtcagatggattgaattaaattgtcaaccccctccttttcttgttgaccagacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatg

SEQ ID NO: 340486 - DNA, 570 bp, Homo sapiens
ccaccggcaggttgtactccaccggcaggttgtactccaccggcaggttgtactccaccggcaggttgtactccacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacaacctgccgtggagtacaacctgccggtggagtacaacctgccggtggagtacaacctgccggtggagtacaacctgccggtggagtacaacctgccggtggagtacaacctgccggtggagtacaacctgccggtggggtacaacctgccggtggagtacaacctgccggtggagtacaacctgccggtggag

SEQ ID NO: 340487 - DNA, 632 bp, Homo sapiens
gctcggtaccctgtgtccctttgtctggtgtttccctttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttgctcaggagactcgtccttggccaaaacagtgcatgccccattcctccagctcacagtcagtgagtgacagacaaagggaacaccg

SEQ ID NO: 340488 - DNA, 5380 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340489 - DNA, 5525 bp, Homo sapiens
tatatcgtcgacccacgctgttcgtgtggattcctagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340490 - DNA, 5282 bp, Homo sapiens
gtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340491 - DNA, 3874 bp, Homo sapiens
ctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340492 - DNA, 3152 bp, Homo sapiens
  misc_feature (23)..(23): n is a, c, g, or t
ctgcaggtgactctccaggattnttcatatcagcgctttcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340493 - DNA, 2624 bp, Homo sapiens
aatcggatttctagttctgaaaaccaactcctgtactgagctgcctcagtagccagacttaacaagacactgctctccccatgcgaagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340494 - DNA, 894 bp, Homo sapiens
ccaccggcaggttgtactccaccggcaggttgtactccaccggcaggttgtactccaccggcaggttgtactccacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340495 - DNA, 5171 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340496 - DNA, 5076 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccactcgttgttggtggcgttgtcctcagaggctgagtgtgtgtggctgcccggcttccgccgcttccgcaggcaccagtagaaggccgtcaccaagcaacagatc

SEQ ID NO: 340497 - DNA, 3266 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtca

SEQ ID NO: 340498 - DNA, 3778 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttactta

SEQ ID NO: 340499 - DNA, 2056 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatag

SEQ ID NO: 340500 - DNA, 320 bp, Homo sapiens
atgcaacaaccaacagaatttttattttggcattatggttttgtttggtggggtattctgggaggccaagaatgtacgagattttggaaagtcgaccctgtttctgaattgctaaattgtttgtttgtcttgcagaggtcctatacgttgcttgtggaggcgtgggattccagtaatgacaccgttcgtaagtatcgcttctgtggacttttctctaaacacacgtggaagtgtggggcttggccaaccagttggagctggatctgtctccttagtacttagcatttctgccacctcttgccttctgttctcccctgtac

SEQ ID NO: 340501 - DNA, 490 bp, Homo sapiens
gaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattg

SEQ ID NO: 340502 - DNA, 6055 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340503 - DNA, 6491 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340504 - DNA, 5159 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340505 - DNA, 5639 bp, Homo sapiens
ttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340506 - DNA, 5731 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacaacctgccgtggagtacaacctgccggtggagtacaacctgccggtggagtacaacctgccggtggagtacaacctgccggtggagtacaacctgccggtggagtacaacctgccggtggagtacaacctgccggtggggtacaacctgccggtggagtacaacctgccggtggagtacaacctgccggtggag

SEQ ID NO: 340507 - DNA, 5143 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340508 - DNA, 1820 bp, Homo sapiens
  misc_feature (23)..(23): n is a, c, g, or t
ctgcaggtgactctccaggattnttcatatcagcgctttcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggccagtagt

SEQ ID NO: 340509 - DNA, 2765 bp, Homo sapiens
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatg

SEQ ID NO: 340510 - DNA, 545 bp, Homo sapiens
gcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtaggagcccttctccgggcctccctcccagccgtcctctccctcccctcgcggcgccctgggcggttgagccccgcgagcaggctcggcagccctcgagcgcccgactcctcgcccctgcgcccgagcggctgcacctgggctgagcgcgccaactcccccacgggagcccctgcctcctgagggtgacccctccaggccggacaggggcgcgttcgctccgctgttgccccccgggaagtcgtcggatttcttccgcactcgtgcatttttttttttttttgccccggaatcatgttgagtccttgaacgtagtttcgcaaaattattttcactcggcgaggagggctcgtcggggcggggagtgg

SEQ ID NO: 340511 - DNA, 384 bp, Homo sapiens
caaaaaacaaaaaaacaaaaaaacccacaaaacccgtgttggttagattttctcaaaagctttacaacaggcaggttacgtgtaagctctgctgttgcccaaaatagtaattagggaaataattgcttttaaatgaatatgtctgttttctagtcagatttgcccttttgttctttgatcagttagttcacgtaagcgggtgtggcagggaggaagcccctggtggtgagagtgtttggagctcaattgctcgaagggaattggtgtcgatatggagtctcgggcagtggttttagtaaccttggataaaccgacctctcaggcttgcacaatttgctaattaaaacagggagcacagctgcttcagttgtaagccgggcgtag

SEQ ID NO: 340512 - DNA, 609 bp, Homo sapiens
aaacacagcagaggaagagggggaagatgaggcttgcgcttccagctgctcctcagtccatccaggcagggccagtagagctgaaggtttcctgagcaatcacccaccaagggtagaatctgctcctagaaacagaccctctcgccagtcagctctgccttgggctttaaatgctcacagcctggggctgggggaggcaactaccaaaacagctcagagtgaggcctctggatgtgcaaggaccagggcctgcaggacccttgctgggaatctcataagcaatgaatggctcatggccttgggcaagttttcacctgtgaggcagagctaggactacccatgtaaaagacagaacagttaatgaatgccaaaatgccacactgctagccaatgcactgtggccaaaagataattacagtaggctcactacacaaagaggccagaccacatctttgagagcacagctttatttggcctggatgcctcgagcacatatcatgtatggcagccccatcctcctccagcctatggactctggaccagagctgcggcccacccctggagggaccagtcctgctggctggaaggtaggtgtcctgacagttgggg

SEQ ID NO: 340513 - DNA, 418 bp, Homo sapiens
acaatgtagcaatggactccattgcctagttatttcttaggactaaatttctagaagtaagattgctagttaaagtgtatgcacatgtttgaggctttcgatgcacaggaacatacttccctccccagacgtcacaccagttgcctttcctcttagtggcctgtgaaggtgagagaccagactccatgaggataggaagtgcaagtcccagattccccacactgctctgccaagtccagggacatcatctggaaatccccagaggcatcagcacatggagcacatcccacgcagggcatgcaggggaaatgtgatcataccctgtgaacatacccagagacagcgaggaagactttgggcacaggagccagcctcggagatggggagttggggaaaggacagacagacagagctccaa

SEQ ID NO: 340514 - DNA, 163 bp, Homo sapiens
atggcatgtttcctgaactgtgttaacaggaagtaactattttaaaaacacaggatgcattttatgattatgttttactgtgtcaacgaacattgtatctgtccacattcactttttgactaccaagcaagtgcatgtttacaattttgattcacatccaatt

SEQ ID NO: 340515 - DNA, 504 bp, Homo sapiens
tcagtaagcaaattaatgaagagaatgaaagaaaaggaaagaatgagagaaaatataaatgtatttggccaaaatcagttggacatctgtgtcaaacttttacacaagagcaacagcctgtaccacagtttgccaaccctgccattcattaacaatgaagacacgatcccacattataatttcctaaatttacaagaaaaataatgcctttggcatcacagtctttgccaaagtatatagaacaggcttccactgaaagttcactcatgctgttaaaatgctttaaatagtaaacagagtagaaaattaaacaaatccacagaaatcaagtactaagcacaaaacaaaaacttagacgtggtcttccagctcctggcactttctctttgcattatgaagcgggagaggcacgggcatcatggacgtcccatggagtacacagagcagaagcggtcataaactgctgccctcctgacgtgtctgtccacatttctctagctctta

SEQ ID NO: 340516 - DNA, 105 bp, Homo sapiens
ctacaaacttttctaataccgtcaattttactctcgctttctgattcatcccagaatagtcctgatctcaaaaaaaagccaacaatgaataattgaaagaatgtg

SEQ ID NO: 340517 - DNA, 321 bp, Homo sapiens
taggacgaggtagtcttgacaaaatattgcagatgaagctgagtaagccttggtcccagctgctgctttcaagagttacagaagaatatgtggaattgttctgagagtatcaatcctggaaaatacagactgggaaactacaagttaatactgtggattcttaaacagataaattttaacctaatgcaatagaagcggaacttacctacaaaaatgcttcaaatgcatcacgtttatttttctgggaagactagaatgtctatagttatacatttaggcattagaattattttaaaagtgagaaagtgctagtaaagtcat

SEQ ID NO: 340518 - DNA, 350 bp, Homo sapiens
tatctcatgctactctcttaatgactttggcaacccctcttctcaaacctccaatacctccttgcacaacctcattctcagctaaagaccttgcttcttattccactgagaaaaatagagtaaccagaagagaacatctgcaagcatcctccgccacatctgtctacttgcttgcatctgcacccgtgtttgtggttttcctttctgatatggtggatggactctcctcatacctgcctggtgccaattcctctggctgggctctggaaacccagctctcctgtcactcctgctcaaggacattccccgctttcctgggcctctcagttgaacaaagcagcaccacgaat

SEQ ID NO: 340519 - DNA, 3390 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcaccacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactggtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagatccagctaacatactatataagccagtgagaccagccagtgtctgttcattgcctctgccttgcccctatgcctgcccgcctcctatagcagggccctatagcataatgaaaatgcgaacaaccttttctctggacactggggaatctagtctggtggataaagatggatggctgttaaacgatcgca

SEQ ID NO: 340520 - DNA, 1163 bp, Homo sapiens
  misc_feature (1)..(1): n is a, c, g, or t
  misc_feature (3)..(4): n is a, c, g, or t
ngnnacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340521 - DNA, 2186 bp, Homo sapiens
  misc_feature (968)..(968): n is a, c, g, or t
cggctagaactgttttgacccaggaaacaatttgactaaaggatatttcaatccaacaaatactctctgggcccttccaatgtttctggcactggtttgatgctgaggacatagagatgaataagaaatggtctctgtcccccagctgataaattatcattgatgatctaccgtgtgccagggactttacaaatgtgattaccatttcttacaacatagtaaggtagatagcatttttgtgttacaggtgaggagtaggaagttcaaaaagtttataaggtcaaagtcacacaactagtcagatgtagaactaacctttggatttgggactgttcaccatcaaatcctatatgcttttgatacagacaggagacccagaaatgctgggtagaagagggtggttccctggcaaaggccctaccctcaaacctggaaacctgcagccctaaatgggaagaggcattcctgttttcatgcccaaaagttgccttttggcccgtcatgtcccctatcctatacctgtataaaccccagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccanaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccatcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgccca

SEQ ID NO: 340522 - DNA, 1567 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaaattatagagatgggctctccctgtgtttccctggttggtctcaaactcctgggctcaagtgatcctcccatcttggcctcccaacttactgggattacaggcatttgccactgtgcccagcccatttcaatatttctgatcaataaatgtgcctgtccttcagattctcctttg

SEQ ID NO: 340523 - DNA, 5588 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagttacactggaagaagagcccctccttccttcaagccaagtcatccccttgggctctcaccacttcagtttataccttgcctgtagtccagtctctccatcatcaattccatcagcacaaagacataatttaattccttctaccttaaaaaaacaaaacaaaacaaaacagctctccctctcttagggtgagatgaagtggttggcaacaggccaatgctactttcagaggcgtttgaatcagagtgactccattttgaataggggttgagtaaaataaggctgagacctactgggctgcattcccatgagcttaggcattctaagtcacaggatgagacaggaggtcagcacaagatacacgtcacaaagaccttgctgataaaacagattgtgataagaaaagccagtcaaaacccaccaaaaccaagatggcgacaaaagtgatctctggttgtcctcactgctgattattcactaattataaaattaacatgataaaagacactcccaccagcaccgtgacagtttacaaatgacatggacacatcaggaagttaccctatatgtctaaaaggggaggagccctcctttccaattgtccacccctttcctggaaaactcatgaataatccaccccttgtttagcatataatcaagaaataaccatgaaaatagccaaacccaagccctcagggctgctttgcctatggagtagccattctatattcctttactttcttaataaacttgctttcacttt

SEQ ID NO: 340524 - DNA, 5026 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcaccacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactggtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagatccagctaacatactatataagccagtgagaccagccagtgtctgttcattgcctctgccttgcccctatgcctgcccgcctcctatagcagggccctatagcataatgaaaatgcgaacaaccttttctctggacactggggaatctagtctggtggataaagatggatggctgttaaacgatcgca

SEQ ID NO: 340525 - DNA, 6615 bp, Homo sapiens
  misc_feature (5397)..(5397): n is a, c, g, or t
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccanaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccatcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgccca

SEQ ID NO: 340526 - DNA, 4949 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340527 - DNA, 4590 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggagagacaaagtttaatcatgtgggccaggctggttttgaactcctgacctcaagtgatctgcccaccttggcctcccaaagtgctgggattacagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340528 - DNA, 5470 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatga

SEQ ID NO: 340529 - DNA, 6813 bp, Homo sapiens
  misc_feature (5397)..(5397): n is a, c, g, or t
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccanaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccatcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgcccagcctggtgtgttagttctgtggaaactgactggctagggtggccacgggaggaagagcctggttctccctcaccagctccttgtgaagaagggacctggtcaataaggcaaacgacaccacttgccaacatttgatattgccaagtgcttttgtttggcactactatagattttaaaaatgtatctcacttttaaaat

SEQ ID NO: 340530 - DNA, 6577 bp, Homo sapiens
  misc_feature (5397)..(5397): n is a, c, g, or t
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccanaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgccca

SEQ ID NO: 340531 - DNA, 3318 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaa

SEQ ID NO: 340532 - DNA, 2082 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctgggttgcagtgagctgagatcacaccagtgcactccagcctgggtgacaagagtgaaactccatcta

SEQ ID NO: 340533 - DNA, 305 bp, Homo sapiens
actaccactgtctgggggaaagctgatacacgaggacttgacaataattacagcagtaacaatcgctactattttgttttgagatgaattttagtttctgaaattgtccaaagcacttttatcaatagaaacttgttacacatccctccaacagggagaagcagcacaggaaacttccccctcaaacactaaaggctcctggagctattcacagttctggggaacaaccaaaggaggaggaggacaaagggaaaaaatactttttttaaaaatcccaaacaaaaccaaattctatacatgtatat

SEQ ID NO: 340534 - DNA, 1756 bp, Homo sapiens
  misc_feature (1)..(1): n is a, c, g, or t
  misc_feature (3)..(4): n is a, c, g, or t
  misc_feature (473)..(473): n is a, c, g, or t
  misc_feature (937)..(937): n is a, c, g, or t
ngnnacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggtatgttggggccctgtgcgtctcngtgtagggatcagacgaaagtgagaagacctctcctcttttcagaaagacggcgtggcctcctcctccctgctgtttgctgagatttttcttacatagccacctgtcacctctgttccccagccccttggatgtgatggtacacagtgggtgggcccccataataagttcctaaagcatgggatctcatcgaataagactcatcatttaatccttgtgagaattttgtgaggtgtacgtgttaatgtcccatttcacgacgaaaagacaagactctggggatgggaatgacttcctcgagaccatacagccaggaaatagcggtgaatctagtgatctcgggtccctagatttaaccatggcactgaggtgccgtgtgacggtggccttggaggacccagcactgacccatagagggctcctctcagatgggcagcagcttggagcaggcaggcagggcctggnccattggaggggctggcactggacttgcctttgaccccagcagcttggatggggtgccgggctcccccatagttcactgactgtctcctttggtcttctcgcaggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340535 - DNA, 5433 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagttccagaggctgggaagtccaaggtcaaggcaccagcagattcagtgtctgatgaaggctctctctttgcttccaagatggcggctcttactgcatcttcacatggcgacacagcattcaacccctctggaggaagtagcatttaaggcaccatcttggaagcagggaccagagcctctccagatactaaacctactggcaccttgatcttggacttcgcagactccagaaccgtaagcatagatttctgttctttataaattacccagtctcagcaggaatggactaagacaaccaggaataattcttccattgtaacagaatgaaagcagataggttggttgatttgaggtgggaagattaagaaggtttttttttcttgttgcttctatactgttttcttagggaaatagtaggtaaaacccacttctacgtatatacccaagagacattaaaacatacatccaatc

SEQ ID NO: 340536 - DNA, 5456 bp, Homo sapiens
  misc_feature (5206)..(5206): n is a, c, g, or t
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccanaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagc

SEQ ID NO: 340537 - DNA, 4494 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340538 - DNA, 4882 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgaagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaatt

SEQ ID NO: 340539 - DNA, 4755 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagttacactggaagaagagcccctccttccttcaagccaagtcatccccttgggctctcaccacttcagtttataccttgcctgtagtccagtctctccatcatcaattccatcagcacaaagacataatttaattccttctaccttaaaaaaacaaaacaaaacaaaacagctctccctctcttagggtgagatgaagtggttggcaacaggccaatgctactttcagaggcgtttgaatcagagtgactccattttgaataggggttgagtaaaataaggctgagacctactgggctgcattcccatgagcttaggcattctaagtcacaggatgagacaggaggtcagcacaagatacacgtcacaaagaccttgctgataaaacagattgtgataagaaaagccagtcaaaacccaccaaaaccaagatggcgacaaaagtgatctctggttgtcctcactgctgattattcactaattataaaattaacatgataaaagacactcccaccagcaccgtgacagtttacaaatgacatggacacatcaggaagttaccctatatgtctaaaaggggaggagccctcctttccaattgtccacccctttcctggaaaactcatgaataatccaccccttgtttagcatataatcaagaaataaccatgaaaatagccaaacccaagccctcagggctgctttgcctatggagtagccattctatattcctttactttcttaataaacttgctttcacttt

SEQ ID NO: 340540 - DNA, 5136 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgtggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagcagcacaggaaacttccccctcaaacactaaaggctcctggagctattcacagttctggggaacaaccaaaggaggaggaggacaaagggaaaaaatactttttttaaaaatcccaaacaaaaccaaattctatacatgtatatctcgagtgagtaaatgtgtaacactcacc

SEQ ID NO: 340541 - DNA, 2271 bp, Homo sapiens
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttgggaatggaccttttcctttcttagcttgctgtagggattgtgcttcagctaaggtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaataatggacctgtgtaaggaggtatgtgtgggagaagattccagaaggtcttgagacactccagatgaaggttggtgtggggctgtgctgctggagcaccagagagtgaaaagaggttatctccctctgtgccaggccagagtgcagtggtgcaatcacggctcactgtagtctcaacctcctgggctcaagagatcctcccacttcagcctcccaagcagctaagactacagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggttagaagcaaggcacaagtcatacctacattcaaggagaggggaccatgcaaaggataaactgcagagagacaacagatttgcatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagcagcacaggaaacttccccctcaaacactaaaggctcctggagctattcacagttctggggaacaaccaaaggaggaggaggacaaagggaaaaaatactttttttaaaaatcccaaacaaaaccaaattctatacatgtatatctcgagtgagtaaatgtgtaacactcacc

SEQ ID NO: 340542 - DNA, 269 bp, Homo sapiens
gacatgagaagtgaggtttcagttctattattattttttaacttattgaattagttgatggagcttaaagactggaaaagatagtagcgtctgggattgataggaggttgcagatttctggctactaagtgcactgtagaagtggtattgatatcagtcttttctttctttttttcttattcttgtgctttggattattatgtaaatatgtgaaacagaacatgcttactttttcttagggacctaggttattactatttctactctga

SEQ ID NO: 340543 - DNA, 1145 bp, Homo sapiens
acatggtgtcaccccatctctactaaaaaatacaaaaaaattagccaggcatgttggcgcaggcctgtaatcccagctacttaggaggctgagtcaggagaattgcttgaacccgggaggcagaggttgcagtgagccgagatcacaccactgcactccagtctgggtgacagagcaagactctgtctcaaaacaaaaaaaagggggcaaaaagtggctaaatttcaagctcttgatggactatggaaagattataatggcctccaccaaatccaaacatggtaattgctccaatagcaaaagtagttaaacatctcttagagcttatggtttgctttactctgtgtatttcacttgtcaacagtgtaaaagctgacagcttaatggtgaaactatctttaatattggcagggaacaaactctcctaaataacctctccttcccaatttaaatgccagaagattgggagtgcctagaagttgtgagtggcttatcaaaaactgtcaatatgtccttggctatgacatttttgttttatatccattttcagcattgtcagagaacattgtcctttaggatttcagagtttcaccaaaacttaagtggagttcagctaaacagctgagaacagtaaatggttttagggtggttgacacgcacacttcttgaatttctacagggccagccttctagcctttaacaattcaggaaatcataaaccatcacttgttcctgccaacttcctaattcctctggtaccatgcagacaaagaaacactctcttccaatcgcaaataaaatcttttttctctttttttaggtggactcttgctcttgtcacccaggctggagtgcagtggggtgatcttggctcattgcagcctcagcctcccgggttcaagcgagttgcctgctcagcctcccaagtaacagattacaggcacctgccaccacatctgactaatttttgtattttagtagagacagggtttcaccatgttggccaggctggtctcaaactcctgacctcaggtgatccacccatctcgggctcccatagtgctgggattacaggcgtgagccaccatgccctgccagtaaagtctttttttttttttgagagggagtctctctctgtcgcccag

SEQ ID NO: 340544 - DNA, 513 bp, Homo sapiens
atctacaggtagaatatgttcagagaaggtcctaagtaagctcttggctgtgttactcagaattgaggtatgctgtcaggtcaggactgccaaaacaagtaagcaaaaagagatttaagaattgaagattcgattttagaatctgaaacacacgccctgggtttcaaggtaaagaaaaagcagaatgttaaaccccattcggatcaccataggtcggagaatagaagaatagtgataacggtgtcattcacatttatgttgtggggagggatgaatgttatggctgtcagacaagatagagaagaaaatacacaaaatgtgtgagatacagtctatgtcatcaagtagctgaaagttcagatggttggtacttgtggagcaataagagaggtaatatgtgctgagtgggacagaatttttgcctaggataaggaagagaaacttttgggaggtaaatgggaattgagttggcttaaataattaaaatataggtaaagaggaatgtgaagtata

SEQ ID NO: 340545 - DNA, 128 bp, Homo sapiens
ttcctgcaaacttggagttagatatagaagcttcaccagattcagggtcacttttgttagcaaaagtatctcatagacggtgctgtctgcttccataaggagccatgcagacccggctgtcgccttgc

SEQ ID NO: 340546 - DNA, 381 bp, Homo sapiens
cccagatgaaggtgtccttgtgaattgtccctcagtatttaagacaacagtatttaagaggaactactgcctctactcatgggctttgaaccaatctggatattctgctagggaaatttagtcaaagagaccagtctttaaattcaaacagggaattcaaagtgacaaaagtacaatagcataagcaaagtatacggttatagtcttaagagaggaacgggactttatcaggcgtaaggtcttactgatagagttgtatcgcaagtattaggaattaatgaggatgggctgtgctgcggcagcttgaagtctgataaagcctcacctgcacccactgaacattctattcacccaggaagaaggctgacaaatctctatttt

SEQ ID NO: 340547 - DNA, 268 bp, Homo sapiens
tggtcctcctgtctcagccatccaagtagctgaggctataggcaaatagtaccacacccagcttttttaattttttgtacagacagggtcttgttttcccaggctagtcttgaactcctgggctcaagtgatcctctcatttcagctcccaaagtgttaagattgtaggtgtgagccaccatgcctggcttatgttgctaaaggtttaatgtcctttatcaatcgagaaagctccctttattcataatttgtttttactttttaatca

SEQ ID NO: 340548 - DNA, 266 bp, Homo sapiens
ggtatgctgggatcacattgattctgtagatcaatttagggaatattgccattttaacagagttgtatcttctgatccattctcatccatgaacatgggatatctttccttttttttttttttttttttttgggggacacagtcttgttctgtcatccaggctgcagtgaagtacagtaatgcaatcatggctcactgcagctgtaacctactaggctcaagtgatcttccctcctcagccccccaagcagctaggattacaggtg

SEQ ID NO: 340549 - DNA, 495 bp, Homo sapiens
gggatagagtaaaggataattgtaaaatttctggttggattatactctgagctgtggaagctaatagccattagagggaaagataattaactcagtttgcaagaggttgagtttctggtgtgtatgctctcttagaaggagatatctaacacataactgaaattctggtctataattcagaagagagggttgggatagaattatgagtttgctgtcagctcagtcatcattttctcggaatcattcactacatttccatgatgaggtcaaatccctctattctaccctcttaccacaccacgtacctcctctccttgtctgtatgcactttccaatattgtaattgctcattcatttttgagtttatttgattaatgctaataacatccccccaccgcctgcaactgtagggttcatgaaggcaagactgtatttgtttttgatccttttgtatccaaagaacacctgccgcacactaggggcccagcacatatt

SEQ ID NO: 340550 - DNA, 189 bp, Homo sapiens
ctttcctttggtttgtctgtagtcctggtagctaaagataaaccagtattaatttttttcagtcaaatcgattatgttctctggagagtaaacaagtagattgacaaatttttttacttttaaactgcccaatgtagctgggcatgatggtgcatgtctgtagtcctagctacttgggaggccgaggtg

SEQ ID NO: 340551 - DNA, 1091 bp, Homo sapiens
ctcagtgtagagactgacatgaataatggttcagtgaaaatgatctcataattcaaaaattccaaactcttaaagaaaacagtctctgaatcctgaaacttagcagacactacaaatagcaagattagagttcagaaattcagataatatatttattaaataaaatctacaggtcctggtgtgctgtgggttcctagtcagctgccatcttgctcctcttcccacccctcactccttcctgctgcaccttctgaatgcagcccaccatgtcctgactctacccagcccagcctcacttctgcctctggtgaccacaggagagaagggggaagctggcaagtagacctgcagaggctcttcccatcgtctccttcaccttggtgcccacatctagttataatccccattaatccattttattaaatgagctgtaaaaatcagcctggggcccagctagtgacttctgctgggcaaatgaacacctggcctgatgccacaagctctactgcctgtgtgctcaggtgagaaggcagaggtcatgaatccagccacagaatgccctagggaggaggactgaattcccagggggagacctgctaagcctttcaaatgggctgtgcctgactggactctcagcctagctctctggaaccctcaaccacttgtcaactgtgccaagacaaaccctcctagacacaaatcgagtatctagcttggctttctgcactgagcagctgactaccagaggcatctgaggcctccatccgttgattgtcgtggagaagactttgttggggaaaataaacccacccttcctgattaaacattttctccttggccttgttgtagggagaggacctgtaggtacttccagaaactagaatcataggatcttccaaacttcctgtctctaagtacaggagctggaatctttccaccaagtacttatagattcaatcttttgcttagtccatttagcttagggtggaaatttctcaaggcaattactgttttgcagccctttgcataacttgcatagctccttgtagtttagtgaatgacactgaataaaacattctgacaaaattttt

SEQ ID NO: 340552 - DNA, 144 bp, Homo sapiens
cgggtagtaaatggcagagctaaggttcaagcccatacccacctggtctttataaatttaggaataagttctagcttttctgattcccagactaggtctaaatttaatcttagctgtcgtatattgaatttttttttttttttt

SEQ ID NO: 340553 - DNA, 327 bp, Homo sapiens
gaagcattataacttattaaatgatattacagacactgccgtgcctctaatctgtaattgaaaataatttccaaatcacacaaagaatggcctcctgtgaattttcacaccttcaaattcagatccagttttaagacatttaatgattacattataaagccaattcatccagccagaaaagctgcctctctccattcttagaaccggagcagatacattagagacaaagcagagccctcacgaaagaagaacaagggtgatgactcacaaagctctatttgggagtctgaatttggggagaatcttgctgctgtagactgatgtatc

SEQ ID NO: 340554 - DNA, 148 bp, Homo sapiens
cgctgttctcaggcagtcagccctacttatcccctcattttaaagtaataatttacctcccttctcatatttctaaggaaatagataatatctggcacatactccctcggcttgcctcccctccgtattcaaacttaccttcatcaca

SEQ ID NO: 340555 - DNA, 79 bp, Homo sapiens
tttagggtctgttgggggcctggagaaaaatcacttgaatgaatttaattagcaaagatgcataaatgggacaaaggag

SEQ ID NO: 340556 - DNA, 365 bp, Homo sapiens
aaggggcctgggactgagccttagggacacttctttacctagaagtcaagcagagaaaggagtgtcagctaaggagatcaagaagcagtggccagtcaggtagatcaaaaaccaggggatgctgttgtcccagaagtcaagagaagaatggatctcaaaagataagaatgtcaggtgagtgcccttccctggaaaagaaaaaagataagaatgatcagttgtgtcaaatactaatgtgagagttcgaaagagataaaaacacactggatttgacagcagtcttactggagccattggccaaaaggccagcgagaatgagggtgataaaatggagagactacagacatttagtttaagaaatttgg

SEQ ID NO: 340557 - DNA, 1093 bp, Homo sapiens
aaactctaggtggtctggataccattgtcaagatccctccacatgtactgagggagaaatgcctgctgcctctccagttggctttggaatccaagaatgtgaagctggcccaacatgctttggcagggatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacggtgagtctgtgacacccccatgttcatcaccttcctggtggtgtctgtgtatcccatgccccggggcccccactgccagggctgcctgcctcctgaaaacagtaggaagagcttgcttgttttaacagaacatttatttgtacacattaagctctttagatgtttgcctatttcaccctaaagctttgagaattgcttttccttgcagtttccgtgattttttgagttattttaaaacttattttttaatcattgttttaaaacttctcatactgaaaatttttattagaaacattgcgatacactaacaaatattggaagtaaatttgaaattaagaaaaatgaatagaatttattacatgctttgaggttgggtatgtttccctttgttaactaaaagatggtggcaggaggcctccttcacctgctggggccttcagggtgaaactaaacttgtcttctctctatcatcaaagcccactagagctttttgctctaaacttgaacagattgtctaaagtgagcattccaggggaaaatgtaaacgtaattggctccttgtatatattatcttctgggaatgttaatgagagagtgattcctcttcaaaattggtgttttgtgttgttttaaaa

SEQ ID NO: 340558 - DNA, 417 bp, Homo sapiens
  misc_feature (43)..(43): n is a, c, g, or t
taccttactacccacgatactggcccaacatgctttggcaggnatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacgataattgaaaacccagatgtcccacaggatttcgggaatcaagg

SEQ ID NO: 340559 - DNA, 1008 bp, Homo sapiens
  misc_feature (43)..(43): n is a, c, g, or t
taccttactacccacgatactggcccaacatgctttggcaggnatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacggtgagtctgtgacacccccatgttcatcaccttcctggtggtgtctgtgtatcccatgccccggggcccccactgccagggctgcctgcctcctgaaaacagtaggaagagcttgcttgttttaacagaacatttatttgtacacattaagctctttagatgtttgcctatttcaccctaaagctttgagaattgcttttccttgcagtttccgtgattttttgagttattttaaaacttattttttaatcattgttttaaaacttctcatactgaaaatttttattagaaacattgcgatacactaacaaatattggaagtaaatttgaaattaagaaaaatgaatagaatttattacatgctttgaggttgggtatgtttccctttgttaactaaaagatggtggcaggaggcctccttcacctgctggggccttcagggtgaaactaaacttgtcttctctctatcatcaaagcccactagagctttttgctctaaacttgaacagattgtctaaagtgagcattccaggggaaaatgtaaacgtaattggctccttgtatatattatcttctgggaatgttaatgagagagtgattcctcttcaaaattggtgttttgtgttgttttaaaa

SEQ ID NO: 340560 - DNA, 768 bp, Homo sapiens
gtcaattaaaaagaaaaaaaagagatagggtctcactgtgttgcccaggagtttgagaccagcctggccaacatgatgaaaccccgtctttactaaaaatataaaaattacccaggcacccgccaccacgcccggctaattttttgcatttttagtagagacggggtttcaccgtgttagccaggatggtcttgatcccctgacctcatgatccgcccgcctcagcctcccaaagtgctgggattacaggcgtgagccaccgcacctggcctcagaattttttttaaatcctgatttctttattgatgatatctagaaatgcagttgatttttgtctattggttttatatatagcagcattgctgattctctcattaacattctatatgtagatttattggagtttcctcatgggcagtcatatcctctgtgtgaatagtgacatttttttttctttccaatctctagctctttatttcttatacttgtccatgctagctaggacttctgtatagtattgaataaaagctacaatgttatacccttggctttttccttgatttaaaggaaattgactgaatggttctccatcaagcatagtgttcgctctggggtttacgtgtgtgtgtatattctttctgaagtaaaaattaattttcaataagaagatctagtaatgaagtataaaagaaatgctagtttacttcattcactaaatttttgttcaagtcttcttgtcttctgatagttgtcttctccttaacaaaa

SEQ ID NO: 340561 - DNA, 163 bp, Homo sapiens
tatcctttcatccattagatatttagattgtttccaagttttggctattacaaataaagctgctgtgaagatttgtacacaagtctttgtacacaaatacacgtttcatttgtaaacaaatacacatttcattattcttggttaaaaacgtagcagtgaatga

SEQ ID NO: 340562 - DNA, 484 bp, Homo sapiens
catcattgaaaggatgtatcttgcaacccaacattttttgcctacaattatatagggggaaaaatgtacatattgtatatttcttgggatatactgttttagtaatgtttcctagtgacaagtctccctgtatctaagacctcatagagtgtgctctgataacaaatggggctctgtcatttgacttgctttggccaatgggacatagaaaatatgatgaaaatgtaggttggaaaagtacttgcccactggtgcttgccttcttgaacaagtgtcagcatgaaccaccagacatgcgagtgaaggcaccagatgaccaaagcctcatttgtgatccagacaacattagcaaaggaaatgcccaggtgaacacacaccaaaatgtgaatcaacagaacttctttttaagccattgagtttcgttggttctttacacagaaaacagtaactgatacacctaagccaccagaacttaatgttttta

SEQ ID NO: 340563 - DNA, 492 bp, Homo sapiens
tctttctcttgttgaggaataaatatttaaactgcaaattgagtgattaacgttctggtaagggaagccagagaaaggaattggttcgtttgagaagctactattagaaaaatttgctggccttctattgaaattttaggttgttcaaacattagaataagagactaaacataggtaaacatggggtgatgattttacataagtctttctggatgctcagttctacagtttcttaaatgtctcccagctgactctgacctaacaggttttctgctgctcagaacaaagctgggcgagtgtccaatacatggaaatttatgggtttgtaggacaatataaaattataacagtctttctggagctgacagaattgcttgctaacttttatttcccccaaactgagatatgaaaataatctaccacttagtagattccatttcatagaagaaagggcatttttttttattatactttaagttctagggtacatgt

SEQ ID NO: 340564 - DNA, 511 bp, Homo sapiens
caccacacccagctgatttctttatttttagcagatatgtagtttcaccatcttggctaggctggtctcgaactcctgactcaagtgatccacccgccttggcctcccaaagtcctgggattacaggcgtgagccactgcactggcccacccttgttttatttttgagttgggttcttgctttgtcacccaggctggagtacaatggtatgagcatagctcactgtaactttgaactcctgagctcaagcggttctcccacctcaacctcctgagtagtagctgggactacaggtttgcactgccatgcctggctaagtttttagttttaatttttatggagatggggtcttactgtgttgcccaggctgttctcaaacttctaacctcaacgtgatcctcctgccttggcctcccaaagtgttgggattacaggcatgagccactgccagctcaggcatttttatttattcttttggccaatgatcagagggccgtgcgattaatttgtt

SEQ ID NO: 340565 - DNA, 438 bp, Homo sapiens
gtgtttgaccacatatgaagattttagtacccttacaatggagggggtaaagtgtaggaataaaaccagtgctacagaatccaagggacctgagttccctgtgtttctgccattgacttgatatattactagacccaattccttaacctccttaagtcttggtttcctcatatttaaaatggaagtttattttaaatttctatccaaagaaagacacagggtcattgaaaagattaactatatatatatatatagagagagagagagagagagaaagagagagggagagagagagagagagagagagagaagagaagagagctttacatcgagattctatataagcagcttgagaaaagcttgagtcaagaggatttgaattccagcaatatataagtaaacgagcacacacattatcagactcggggtagcgagctc

SEQ ID NO: 340566 - DNA, 337 bp, Homo sapiens
tgctaatggctatattctgcttctgaaccaaatcctttttgttcttagagattttatgacatcgaattatgctgtataattgtgccattaaagtttatccaaatgagccccttctttcctccaaactttggagctgaagcaaaataactcccaagtccttggaagaaatattgtgcctcttcccaaccctaaatcctgatcttaatatctgaatcctccagtactgttgcctctctctaaaatacagtctgggccgcacttactttaaaattagttttatttgataaatgagcatttaggaggccagccccataaacatctagccatatagacccct

SEQ ID NO: 340567 - DNA, 221 bp, Homo sapiens
ttgtgcaaactacttctttcaaaattttgcttaagaacgaaggaggaggagaagaagaggaggaaagaggagaaggagaggagaaaaacacagtagctagtgaagaacaccaagcacttttaagagtaggaagcatgtccctaaggaaatattctgatacagagctgggaaacttgtggacatgacaccctctgggatagggggaggaaaaggagggagaa

SEQ ID NO: 340568 - DNA, 777 bp, Homo sapiens
cagaggttgcagtgagctgagatcgcaccattgcactccagcctgggtgacggagcaagtctccgtctcaaaaaagaagaaagtgaaagttgggtggtgtggcacccctgtgcctgaagtcttagctacctgcgtgactgaggcagggaaaagactacttaagccaaggaggttgaggctagtctgagcaccttggcaagacccatctcaatacaacaacaacaacaacaacaacaaaacgaaaagaaaaataaaaattaacccagaatagccaaagctatttctaagctgaaagggagaaataactttacctgacttcagttatgctacagagctatgataaccaaaacagcatggtactagcataaaaatagacacatagaccagtggaacaggagagagaacccagaaacaaatccacacacctacagtgaacttatttttgacaaaggtcccaagagcataaagtctcttcaataaatagtgctgggaatactggatattcatatgcaaaagaaaaacttgacccctgtctctcagcacatacaaaaactgaaatcaaaatggatgaaaggcttaaatctaagatctcaaaagtatgaaactactataagagaacattgggaaaactctcccggatattgatctgaacaaaaatttatgagcaataccccacaggcacaggcagccaaacaaatatggataaatgtgatcaaatcaagtaaaaaagcttctgcacagcaaagtatacaatcaataaagtgaagagacaaccca

SEQ ID NO: 340569 - DNA, 529 bp, Homo sapiens
tacatccacacaccatcacactacacacacttttacatgctttcacacatacccgttggatatggacacaccaacaagcactcattcccacacatgcttgcactgcacacactgacacactacatgccttcatagttgacacacacttccatgcattcactcacctttttgcacactcattcacactcccatcacaacactgacacacttctgcctgtcctcacacgcctacacacttgccacacacacactgagtgttccatgcacactcacatcctgcgcattcagtcactaacttaccctcatgaccacacacacacagactttcaaatgcactcatccacagacacatattctcatatgcatacgcacttgcacacaaccctcgcacgcttgttcacactccctgacatgcagtcacactagccatcactcatgtgctcacacacatacacactcacatcctgcgcattcagtcactaacttaccctcatgaccacacacagcacaccgcacaatgcccgattca

SEQ ID NO: 340570 - DNA, 103 bp, Homo sapiens
taaacattctccatggctcttttaattcggatgccctttatgcaatctctttcactcccttggagagcactgagtcttatatctgggacatactcaatcattt

SEQ ID NO: 340571 - DNA, 399 bp, Homo sapiens
gactctccaggattctaccacggcaccccctgctcaaacacaccttgttaaaagcacacacataccaccgacctttgttcattgctgatgctcttactgataacccaccctcccagtgaagttgcttactagagtaagctcacagagggcagactctttggttttgcatctataccctgagctggtgagtagtatttttttttcataccctgagctggtgagtagtatttttttttcaatcaacttggaattaagaacttgtggaaaactggacatttcgctataggaagcattgtgatagggaggtattatgtagaaagtctgctctaggaaattgaacattaacttttcatttgagtggcatagctaaatataagttttgatgtaaagaaatttcag

SEQ ID NO: 340572 - DNA, 187 bp, Homo sapiens
acagatgtgagccgctgcgtattgctcaattacttaatttatatctcagtttcctcaccagtaaaaaggggataatagtacttatttaatgcgtttgtatgaggattaaatgaggtaatgcttgaacaatgtttagaactgtgcctgacaaataaaagatataaaaatataaataggtggatgggtg

SEQ ID NO: 340573 - DNA, 2722 bp, Homo sapiens
tggagccagtgccattcacacttccccctcttctgcagcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggtgagtttgacaaatcctgcagtgtttccaggcatccttttaggactgtgtaatagtttccctagaagctaggtagggactgaggacaggccttgggcagtgggttgggggtagaagttcttcctttcctaacccgggcccctgcccagctctccaaagtctttcagaaaagtaaatcctaaattcagtgataaactaactgttttaactggttcctctaccctgaggtgacagcagagggcagcacgagcacaacagaaaccagcttacactttaagcaagtgtagctggattttccttacaggatgaggggtgggtagcagggtacaaaacatccttttttttttttttttgagacggagtcttgccttgcgcccaggctggagtgcagtggcgcgatcttggctcaccgcaagctccgtctcctgggttcatgccattctcctgcctcagcctcccgagaagctgggactacaggcgcccaccaccacacccggctaacgttttgtatttttagtagagacgggttttgaccatgttagccaggatggtctctatctcctgacctcgcgatccacccgcctcggcctcccaaagtgctgggattacaggcgtgagccaccacgcccagcccaaaacattcttgaacttgtttgtcatttccccttctagggcactgggcagcaaatgttatctgaaccattgcttcactgttagaaaaaccctgcagtgggagagagctt

SEQ ID NO: 340574 - DNA, 2406 bp, Homo sapiens
  misc_feature (248)..(248): n is a, c, g, or t
  misc_feature (504)..(504): n is a, c, g, or t
  misc_feature (1746)..(1746): n is a, c, g, or t
actcttgataagttgttttccttccccctctaaaatagattctatttgtttagagaagttttaagttcacagcaaaattgaatgaaagatacagatatttcccatttatccccagcacccacacatgtacagcctcccctgttgtcaacatcccccaccagagtggtacattttttacagttgacgaacataaattaatacatcattgtcacctgaattccatagattatattaaggcccactcttgntgtatattctatggattttgacaatgtacagtgttaggtctgattttgaagtctatatgcttggacaagtaatttacttttttgacacccccctgcccaagggtgctgctatactttatgaaaatacaaagacaattagggaaaaaggcagttaggcacaaaaatgtaagggcagttcaggtagggtttctgtattttctgctcttctgatgtttctccctgtgctagatgcccaggcatcacctccagatagtcncacaagccactgagcttgccacttggttttctcttagagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtaggtaaatgctggttgctcccagttgtcctggtgcaaagagccaccccagcattatatcgacaaaagatgtggaattctcaccacagaaggcattcctcttagctatgagggtggcaccctgggtatttgctaaacaaaatgatcttctcccctgaagttgcgcttccttccccagtttccttgagcaccttgaactttttatctacccagtggtgtgtggcattgcttcagtggattccctccagggaaagcaaggggcccacgagtcagcacttgatttttcatcttggcagacatagatccccccaagatccgctgtccccactcacgtgagaagatggcagagccagagaaattgactgctcgagtatactgggacccaccgttggtgaaagattctgctgatggtaccatcaccaggtgagcctgaataatggatgccccttatgccttccctcggcttctctcagtcattcaggctggtcacattgaaactgcacaggctaaggtgacagtggggatgtgcctcagacttcaattctaagggtctctttcctcagtgtttatttcaccctgtcccatgcagggtgacacttcggggccctgagcctggctctcactttcccgaaggagagcatgtgattcgttacactgcctatgaccgagcctacaaccgggccagctgcaagttcattgtgaaagtacaaggtcagaaagaattatttagtttccatattgttcattaatcctgctctaccctgacccaccccatgtctctcctctctatgcctggaagagacacacctcatttatactgggagaggagaaaaacaagttcaccaaacaggcttatttaggaagccagcgttacatgtgcatacatatgtttctgaaaccttgactctccaacaagactctcatcaacaagactctcattatcctaaatccagataaaatccacaaggatattctttatccatttcttttcttagacttcaaaatgatcacatgtaatcagccatcattctntcgttcacctctgataaaactggtggtgttggctgcctgattcttcctctttgctttgtgttgtattgttttgttttgcttttctcattataaaaataattcatgcttattgttgaacatttgataaataaagaaatatataaagggggaaaatctattaccccatcatccagaggcaactgctattaactttttggtattttccttccagtcttttttctatacatactttaaaaaatatatagttgagattgtactgtacatccataaatcatccttttcacttttcattaacaaagtaattttcccatgttatttaaaaattcttcagaaatatttttaatgacagcataatattctactctaaaaatatatcgtaatttgcttaacccttctcccaccaatgaacgtttaagattcctccaacttatttctgttattaagaggaattctgcaaggtagtcatctttacacagcatgtccataaagtctggaaacagatggtaatattttcttttaaagattgtcagtcttttgataacaacatgtatattcacctgtgtttccagactttacaaacctttgtctgcatttcagatttaattccttaagaaaggaaaattccagctctatccccagccagtggaaatacagaaaagc

SEQ ID NO: 340575 - DNA, 2170 bp, Homo sapiens
tggagccagtgccattcacacttccccctcttctgcagcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggtgagtttgacaaatcctgcagtgtttccaggcatccttttaggactgtgtaatagtttccctagaagctaggtagggactgaggacaggccttgggcagtgggttgggggtagaagttcttcctttcctaacccgggcccctgcccagctctccaaagtctttcagaaaagtaaatcctaaattcagtga

SEQ ID NO: 340576 - DNA, 2746 bp, Homo sapiens
tggagccagtgccattcacacttccccctcttctgcagcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagcttgcctttcttctattgctacagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggtgagtttgacaaatcctgcagtgtttccaggcatccttttaggactgtgtaatagtttccctagaagctaggtagggactgaggacaggccttgggcagtgggttgggggtagaagttcttcctttcctaacccgggcccctgcccagctctccaaagtctttcagaaaagtaaatcctaaattcagtgataaactaactgttttaactggttcctctaccctgaggtgacagcagagggcagcacgagcacaacagaaaccagcttacactttaagcaagtgtagctggattttccttacaggatgaggggtgggtagcagggtacaaaacatccttttttttttttttttgagacggagtcttgccttgcgcccaggctggagtgcagtggcgcgatcttggctcaccgcaagctccgtctcctgggttcatgccattctcctgcctcagcctcccgagaagctgggactacaggcgcccaccaccacacccggctaacgttttgtatttttagtagagacgggttttgaccatgttagccaggatggtctctatctcctgacctcgcgatccacccgcctcggcctcccaaagtgctgggattacaggcgtgagccaccacgcccagcccaaaacattcttgaacttgtttgtcatttccccttctagggcactgggcagcaaatgttatctgaaccattgcttcactgttagaaaaaccctgcagtgggagagagctt

SEQ ID NO: 340577 - DNA, 2033 bp, Homo sapiens
tggagccagtgccattcacacttccccctcttctgcagcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggcagtgggctacatcagtgggctacgtcagtgggtcatcagttgggtacaccag

SEQ ID NO: 340578 - DNA, 399 bp, Homo sapiens
tttttgcatatggaagtacaagtgctccagcaccgtttgtttgaaggctatctttcttccacttaattgtttttgcacttttgtcaaaaatcatttcaacacacctgtgtgggtttacttctgggctctctatttttttccattgacctatttgtcttttcaccaacaccacactgtcttgattactatacttctagcttgcctttcttctattgctacagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaac

SEQ ID NO: 340579 - DNA, 2450 bp, Homo sapiens
  misc_feature (151)..(151): n is a, c, g, or t
  misc_feature (849)..(849): n is a, c, g, or t
  misc_feature (1154)..(1154): n is a, c, g, or t
  misc_feature (1164)..(1164): n is a, c, g, or t
  misc_feature (2317)..(2317): n is a, c, g, or t
atgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaagccgnccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgncgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctnagtccgccgncctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtgaaaaaaaaaaaaaaaaaacaaacaaaaaaattttttggggccctcgcccagaaaagtttttaaacccctctttgggcgccgggcccacaatgtatgcaaaactgggcaacgtctgccccaagagcaaacccgggtctagaagatgtgcttgtgcttttccccacccaataaaaaacgcgcgcggggacacccgggttttggaacaatcacaatggatgctcgggctaactggtcctcacaaccagggcccccgagtcgataaacacnccgcgccgggagaggaagagagcgcacgacgacagcacgagcgactacgagcacagagagggcgcaaccaagcacacaacagaaaaagaagaagcaacaaacagatagagaagacgcgaacagcgaagaacga

SEQ ID NO: 340580 - DNA, 271 bp, Homo sapiens
  misc_feature (6)..(6): n is a, c, g, or t
gtcctntggtttttttttttcccctttttctgaaaaccggggtctcgctatattgcccaggcaggtctcgaactccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtga

SEQ ID NO: 340581 - DNA, 2097 bp, Homo sapiens
  misc_feature (151)..(151): n is a, c, g, or t
  misc_feature (849)..(849): n is a, c, g, or t
  misc_feature (1154)..(1154): n is a, c, g, or t
  misc_feature (1164)..(1164): n is a, c, g, or t
atgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaagccgnccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgncgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctnagtccgccgncctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgggggccgcggttccaccctcgggtgcccgagcacgccgggcttagatggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtga

SEQ ID NO: 340582 - DNA, 2051 bp, Homo sapiens
  misc_feature (151)..(151): n is a, c, g, or t
  misc_feature (849)..(849): n is a, c, g, or t
  misc_feature (1154)..(1154): n is a, c, g, or t
  misc_feature (1164)..(1164): n is a, c, g, or t
atgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaagccgnccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgncgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctnagtccgccgncctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtga

SEQ ID NO: 340583 - DNA, 2401 bp, Homo sapiens
  misc_feature (151)..(151): n is a, c, g, or t
  misc_feature (849)..(849): n is a, c, g, or t
  misc_feature (1154)..(1154): n is a, c, g, or t
  misc_feature (1164)..(1164): n is a, c, g, or t
  misc_feature (2268)..(2268): n is a, c, g, or t
atgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaagccgnccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgncgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctnagtccgccgncctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaaaaaaaaaaaaaaaaacaaacaaaaaaattttttggggccctcgcccagaaaagtttttaaacccctctttgggcgccgggcccacaatgtatgcaaaactgggcaacgtctgccccaagagcaaacccgggtctagaagatgtgcttgtgcttttccccacccaataaaaaacgcgcgcggggacacccgggttttggaacaatcacaatggatgctcgggctaactggtcctcacaaccagggcccccgagtcgataaacacnccgcgccgggagaggaagagagcgcacgacgacagcacgagcgactacgagcacagagagggcgcaaccaagcacacaacagaaaaagaagaagcaacaaacagatagagaagacgcgaacagcgaagaacga

SEQ ID NO: 340584 - DNA, 1888 bp, Homo sapiens
cgcccgggcaggttagaattcagcgaccgcttaattctaggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagt

SEQ ID NO: 340585 - DNA, 2074 bp, Homo sapiens
aaagcgagggctggaagtctggagcaggtgcgcggctgcaacggcagccgcgggaagctcgggccggcagggtttccccgcacgctggcgcccagctcccggcgcggaggccgctgtaagtttcgctttccattcagtggaaaacgaaagctgggcggggtgccacgagcgcggggccagaccaaggcgggcccggagcggaacttcggtcccagctcggtccccggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagt

SEQ ID NO: 340586 - DNA, 1018 bp, Homo sapiens
  misc_feature (788)..(788): n is a, c, g, or t
gttgacattttgacacttctaacaacttcaactttgtcaggccagttgttttaagaatattgtactactcagatataaggtggtattaaaataatcaaactcattatgccccagaaagtagccccagtgaatgccactggaatgcttcgagccactcttgggccaggtgccagtgatttcctcactgcctgagttattccagttaccttggagtaggatgaaatttgcaaaatcaagacaatttttcccattttaattaccacatttgtagttcaaaaaatttcaaatctatacaaaagcaaatgaataccccatatgtctatctttttgccatatatgctttctctctctcgctctctttacacacacacacacacacacacacacacacacacagagtacataaatccctagaaatagcagtagtgatgacaggacatattatctatgaacagagcttaaatagtgctgtgaggaagctccattacattaatatatatcaataaaatgtgaaaacaattttatatagacaactccaaagagcgagataaagaacaagagaaaaacaagagaaaagcagaaggaacttataaggcagaaaaaaacttagggtgttagaaagacaccagaaagtgtagtgagtgagtgaattaataatcagctctttgggaaaggtttcctccgtttttacagtggctctgggaaatacttttaagccaatagcgggcaattggttcgtcacttttcacagaacattttcccccgtggggggatttctcaagtggggncactaaaagaatccacggtttcaaagacaaaacaccaccctttttctgccctgcagaacaaaatgtgggtgtcaatttctcttcaccatgtgttttcacaacatttatctcttcggtcttaacacaggttttctgccacagaaaatatgtctctcttctagcgatggatgagcgtgagcacatcacttcttggacaaaccacacactctcttgttcgtgacaagcatata

SEQ ID NO: 340587 - DNA, 383 bp, Homo sapiens
aggaaagtgtatattcaaggttgaaatgtgtctatgggtcaagaggtcaagcctaaagcttctaagcacctaccagagccacaatgaggaactctcaggacaatgcacacactgatgacagcactgtagcaccagtgaaaacactcaggccatcaacagcatgttcatgaattattcttccaattacactttaattataaaaactagcttattaattaaactaatctactctggtaagatcagttaccacacaaaagcaatggctcttcaagttaccttcatggaatacagtacagagtttgtgttaaaaatgcattttcacttagttgtggttattaaagactttgatcaaggcagaacctctggaaatacaacgaatcttg

SEQ ID NO: 340588 - DNA, 658 bp, Homo sapiens
gttctatgccacttgagaataatgtacatttgagctatttgttaggctctggcttcactccatgcatatctttataaagcaaaactttgttgtttaaatatgggttcatagtaatttatttcctccatcaaatttgtatagaaacttgttaaattctcacacaaggttgtatatttgccaattcctccttattttgttcattttctttaaatatgttgagaccattaatgactttataacttcttagtggatttcttttcttttatcattatacagcattctgctttatccatattggtgcttttgccttaaaatctcttttaccaagtgctaatgttgttatacaaacttttttttcatatttttcactcaatttatgttaagccatcttgtgcagctttgttttatgtctcttgtaacagcacttagcttttgcaattttatctgataatcttagctttttaatgaatttttatttgttttcatttattatgattccagatgtatatggacctgtatcttctgtggtagtgttgaccattcttaatttgtgtttttttgtgtgtctctttcctgatttctgatggattgatataaaattctatattctcccttttccccctgctggtttggaaattaaagacaaaatttctgtaat

SEQ ID NO: 340589 - DNA, 2219 bp, Homo sapiens
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaaaatggtgt

SEQ ID NO: 340590 - DNA, 3410 bp, Homo sapiens
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaaaatggtgt

SEQ ID NO: 340591 - DNA, 1808 bp, Homo sapiens
  misc_feature (1582)..(1582): n is a, c, g, or t
  misc_feature (1620)..(1620): n is a, c, g, or t
  misc_feature (1671)..(1671): n is a, c, g, or t
  misc_feature (1747)..(1747): n is a, c, g, or t
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggagtgcagtggtgcatctcagctcactgcaacctncgcctcctgggttcaggtgattctcctgcctccgcctnctgagtagctgggattaaaggcatgtgccactgtgcttggctaattttttngattcttagtagagatgggatttcaccatgttggccaggctggtcttgaaatcctgatcttaagtgatccacccancctagccttccaaagtgttgggattacaggcgtgagccaccgtcttggccccctgtctctt

SEQ ID NO: 340592 - DNA, 2954 bp, Homo sapiens
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttga

SEQ ID NO: 340593 - DNA, 475 bp, Homo sapiens
atgggagaaatgtgtaagggggtaaacctgttccttcactccccaacttcagtttgggagactgggaagttactgccggtggtcttaagaaacagatattaaaaaccaaccaaaccactccttcaccagcggaggccgagagcacctggcaggcagcctctggccagcactggactggagcatgtgcgcctgccatccttaggttacaagaaaacgctttctggttcctccgtgtgtcttctaccggcctgttagagccagctttgtggaaactcttccccagactagacgcagctttggcaagtgccagtactgaaggggatggcttcaattcagcatggcctgggctgtcttgtgagtgcgtggaagtcgtgcttaggaatgaccgcccctgtagtggctaaagagttcattaaaaaatatctcctgaaaaccggtccaggtgcacttttcagcaggtcattgaggagagttt

SEQ ID NO: 340594 - DNA, 161 bp, Homo sapiens
ccccatagaacaagtcccaacatgctctctcccagtgacatgtccacagagagccacagcttaccgttctaccaggagtccatcagacgctggtcctggctcattcttgcccagccctgtggtatggcaatgcttggaaggctcttttttttttttttttt

SEQ ID NO: 340595 - DNA, 270 bp, Homo sapiens
atctcttaagcaggctcatccttattgatgaatatatcagagggactggtggtgatgaaaactacaataatggtaaccaagttgattcctggattccacctatttccatagtagtacaagggagtctccattcagggcatgatccagcttttcttatgattctgctgtggcagcagaaagctagttctttcttcatttgtctttcttccttcttcccttactctcacatctccccccttgacaatactactcagtatcagtacttcaacc

SEQ ID NO: 340596 - DNA, 442 bp, Homo sapiens
cgtaggacttgaatctccaattttccctagcaatgcacagtgtctgcccatctctgcccagatagtacctgaaattagagtagacttcactagtggaaggaataggatttattccaatttgtgtggaaggagaactcataaggatttaggaagtggcatctattgattgtctgtcttcattcagtttgagattttcctggttcttagtgtgtcaagtgattttcgatggaaacttggacatttttgtattatgttatgtgactctagatcttgtttgaaacctttggttttaactggctttgtctgacacctctatagcaggggaagcagtgggtgccgccttgtcaccccgacatggaggtaaaaatcccatttctccacctgtcctctgttgacatgctgtgtatgtgtgtggggtgtccttgttactgttgggcacagg

SEQ ID NO: 340597 - DNA, 458 bp, Homo sapiens
gtgtggtggcatgtgcctgtaatcccagctactcaggaggctgaggcaggagaattgcctgaactggggaggtggaggttgcagtgagccaagatcaagccactgcactccagcctgggcaacaagagtaaaactccatcccccctgcccaaaaaaaaaaaagtttcccaattaggatgaactacctgcagctcccagaatagcagtgttgtttttaaagacttgtagtggtgtggtcctctccaccaggtatgcctgtttttgcctatctggcaaatatcctctctcacaactgtactcaaaagtcaccttctctgtgaagcctcttctgcagcctcacagcctgcaccctgctcaggaacacccggctctcccattctaggggcacacgtagcagttaacaggcctgtagtggcagccatctcacccctcgtcattgtcccttgacaggcatggct

SEQ ID NO: 340598 - DNA, 270 bp, Homo sapiens
caatactttcttgtctgtctttttgattagtgtctcattgtgatgttaatttgcctagattgagtgacttttggttgtatttggtttagctagtttcacttcatttaatgaatgccctttttagtgttataaaaattaggagctgaaatgaataatacatagtccttccttgcaaggagctcatagttccttcaggaagacagacaacaaaacaatgacagtatagcttgttaagtgctgctgaagggagttgaggacaagatgctctgg

SEQ ID NO: 340599 - DNA, 348 bp, Homo sapiens
gcagaagaaccgcttgaacctgggaggcagaggctgcagtgagccgagatagccccattgcactccagcctgggcgacaagagtgaaactttgtctcaaaaaataataataaaaaaaaaattgaaaagatcaccaaccgttctctcaatctccatttatctaaattctttgaaatcaaacttgttttcctgtcactccccattctgactcttttcccaaattccctgcctccgctaatggtattattagtaattcagttactgagctttaagtctcagaattgttctcaagtatttgctccttattcctttgccaataacacacatactcatacaccatgtataatta

SEQ ID NO: 340600 - DNA, 421 bp, Homo sapiens
atggcagtaaaaaggtatatgtgatcgcataagtgggtagtaattggctacaggtgtctgagggggccttagggaagcaagaggaaggagacctggagaatagctggctaacaaccgtggacaccaaaacaagtcaggtcagtcagttacagaagagatatctatgtgcaagcatgaggtagggtttttagctttctcatgtgtgttctcaaattaagctccaacaccagaaacagcattggtcagcaggtctagaggattttggactaactgaggaggtccttgattgccacacaaactggcactgcctactgccaaggccagaacgctaagaagaaaatgaatgctgcttaaatttaagaatgtccttaaattactactatcttcacctctcctaggcttaccactaatcttttttttt

SEQ ID NO: 340601 - DNA, 348 bp, Homo sapiens
cctcccattgtgaggaaaagatccccaacacatgggcttttgtacccgtccttccttccctgcagttttgatccagcagttctgaggcttggtggggggctgcaatttggacacagaagcactccccatcccaggagtgcttggggacacagcagctatacagagcctgctgcagcgggtggctgggtgctggcgccttctggctggcctccctccatcaacctcgcttccctggggtgcactccctgctgaagggctggcacaactgctccagctccagctgtgtcttctgggaagcctgaattttttttttttttttttttttattgagacggggtctcactctgt

SEQ ID NO: 340602 - DNA, 625 bp, Homo sapiens
gacaggccagcaggacaatgaagtctacgctgcccagctctttttctgggtggaaagccctctttccctcacagaatttccatccatggagagcagtgagcaatgcaaagcattacaaccatttttcttccagctatttctaggcacacaaataacatctaaggactcaaggccagcctgagaaacaattgagccaggaaatactcaagccagtgcagaggtaacagagcctaaaaaagttaaaagcagagggcgatgccttcatggcgagcttcctggcttttcccagacagactgcctgctccaaatgcgaagtttgataaggactgtggggctagtactccaatcacagggactcaattagagtttaggaaaaaatggcctgaagttttcagggataagtgtccaaatttgtttccaagtcaacaaattcattgcacatctactatatcccattttcctgaaatccatcaactctcctagcaataagaaacgctgcattcaggcttttccatttacaaagatctcaggatggatctctgtcacaaaacctggactgccagtatcttcccaaagtcaaatttaagagatcaatcctaaagaaactatttctgtccatctgcca

SEQ ID NO: 340603 - DNA, 321 bp, Homo sapiens
cccaggtatctactaccatggattttatgttttagtcttttgcttttaaaagaaaatagttttgtaattcctaaacaatgtattgtttgtttttgagctttgtaaaaatggtattctatatgtggtaattggcaacttgccaattgaaaaaaaagttcagtatatttttgaagtgtagctgtagttcattcatttgcattcctgtctagttaagattatactacacctaagcttttgattatcctgctgatggattttttgttgttgttgttgttttacgaatagaacgcttctatgggcattctcacacatgtctcctga

SEQ ID NO: 340604 - DNA, 600 bp, Homo sapiens
gattcaacaatgcccagcattgaaactaccttgtttcccagttactcagttccttgtcctgttgctcaaggtgaagtgtccatctttcctgaaattatccactaccccttctttgtttaagtcaccggccttgcctcagacttcactgagaaaacagaagccgtcagaaagttaagtcctatattctacctccaattcaccttgcacttgtgcccccattctttgtcttctgccacactgcgttgtcttgctcccactaaaggcaagtgttcttcctgtgtcttgaattccttaagaatgctgctcccggccaggcatggtggctcacacctataatcccaacattttgggaggcctaggtgcgtggatcacctgaggtcaggagttcgagaccagcctggctaacatggtggacccgtctctactaaaaatacaaaattagctgggtgtggtggtgcatacctgtaattctagctacttgggaggctgaggcaggagaattgcttgaacccaagaggtggaggttgcagtgagctgagattgcgccactgcactccagcctgggcaacaagagcaaaactgtctccaaaaaaaaaaaaa

SEQ ID NO: 340605 - DNA, 504 bp, Homo sapiens
ggaggtctgaaggaaatgtagaaacaatcaaaatagagctaggagggccggttctggaggtggtggaagaacagactgatttgctggtttggctgtggccatcagggagtgacccacagggatgagatcaggccagggaagaggcacagccccccaataaccatcctactccactgaggttggcctctttctggatgcctgttggacaccccctctcagcagcctctgtgcaaagtgctgctgggcactggcctcacaattcctgcttttcaaggcccacatcaggttccgaatgccaagtttataaatgtctggtctcaagagagaaacggacgtggtgacaacataatcacccaagcagttcccttaggttacacctttccttaagggagtcttgggagcttcttcccacccttctcccattcccactcagcagccaaaaccagttgggtaaagtaacctagttctgagaccaccctgccgcatcaccttggataagtcacc

SEQ ID NO: 340606 - DNA, 399 bp, Homo sapiens
cacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttaggattagatgagttttactgggggtctgaagaaactccccaggcctccacaaataagttcatagggggtctaaaggaactccccaaacctcc

SEQ ID NO: 340607 - DNA, 135 bp, Homo sapiens
ctcatgccattcctttcctcctttaaacagaaaaataattagcaggcaaataagtatttcccttttgcttctcctatgagccactaccaggtagacagatggaatattcttttttatttttattttttctccttt

SEQ ID NO: 340608 - DNA, 1279 bp, Homo sapiens
ggccagagttccaatcgaggtgtgagcagggccacactgcctcagagggctccaggggaggctccttcctgcctctctggcttctggtggctccaggtgctccttggcttgtggttgtgcccctgccatccctgcctccacatcgtccctgtgcgtctgtgtccgctcttttttttttttttttgagacagagtcccgctctgttgcccaggctggagtacagtggcgcgatctcggctcactgcaacctctgcctcctgggtttgagcgatcctcctgcctcagcgtccctagtagctgggactacaggcgtgcaccaccatacctggctaatttttgtatttttagtagagacagggtttcaccaggttgtccaggctagtcttaaactcctgacctcaggtgatccacccacctcggcctcccaaagtgctaggattacaggcgtcagccactgcctccggcctgtgtccacgcttcttgtagggacaccagtcattggctttagggcccaccctcctctgagatggcctcatctcaggagcctcaattccatctgcaaaggctctattccaaataagatcctgtccacagggtctgcgtggacatgggctttggggggggaccctgttctacccacactgcccttgtccttggaaagccacctctggccgtgtttttggtgtccatgcgttgaccctcgctgcttctctccaggacttctgggtccatctcatcttggcacactgggccatgccccacctcccaggagagggtctgcaggtttcagaccagactgtgacctcccttgggttcctgcctccaccccaggtacctccatctctccccattttcacacaggcagacagagccaggggcaaacccgggacctgcccagccagcagcctgagtggctctgggaggagcagagccattgatggggacgtcttgaggcctcttctctgagggcctctgcacacagcaggcagtggtcatttggggctggggccggcccgccggctggaacctcacccacagcctgcgtccccctagggtggcctgtgcagggtgcttgctgtgacagtgagcgtgttctggatctaccccggccagtgcgacagctgccagcgcgtggcgggtgcgactgaggaatggcgtttttcaacctactgaatcgtaatgaatttaagttgaatagccccgtgcggctagtggcccctgtattagaagccctagaacagggtcccagggcatggcctgcatgccagggggaggcagg

SEQ ID NO: 340609 - DNA, 2106 bp, Homo sapiens
cagtttgcaaagggacagaattcgtctcacttattcactgcttattgtgtgcctctcgtgttttttcttcttgtgggtcggtgtatttgatgctggttagtagagacaaagaagaaggacaaacaggataaaggtggatctttggtgtggaccctctgcactgcgaaagaagccacatcaccgccaatgtggaaaatatgcaaagtgccgttaggaagaaggaaggatatgtgtgcagcatatgaagtgccttgaatacgattaacttcccttcatgagtagtaaatagtagataactctgatcaaaaaagggattcatgtgatttatcaagctgagcaactgcgcgtctgcagagaagctggaggtcaatcttgaaatctagggcaagaggagcactaggcaattgccaggactaagaagttaatcatacccttggactgcttccatctgtctcagagtgacagcgctgctctcagcgagcaggcatgctttatagcagcagatcaggaattaatattttctgtgaaacctcaagcatcatttgcagtaacttgggttttataaaaatggaacataattttatatgaataaatcacgttcagctagaaatacgagaggctgcaaaaaattatgcttgacttaaaaaaaaagagagaggaacgagcaaaaaagccaacatgaaaacagttgttgaagcgatggcacttggagggcacagatagccatgtggttaaattgtgcatataatcatctgaaatgtcagcctgcgactccagcaacggctacatttttatagccttggagatgcatcaccagactgtaacctgtctgcccatctggcagtatctcaggcccaagatccatttatattgaaatccaaacaactgccattgatttattcatttatttcacaaatatttactgaacgcatccagcatgctctgtggggtgctgtgctggggctgggggtgccaggatgagaaacagccgtgtggctgtgctcttggcttcaccagccagacgagtgttgcctttgcaaggagaaaggactcacaaggcttacacatttgctgccctcagttttgccctttctcaaataaatctcacacatccaatctccttgttgcccattagggagtatataatgaaattaagtaaatgaggaattgcctaaaactaagggagtttcacctccatgtaggtagaagaatgtgaaatggtctgtgtccagaagccagatcagaaatggtccatagcaaggtggggagggcagcgggtacccacctggcagtgtagggggttggattcagcttcatcttcctgaccccttgtcaagtggacgagctccagccaaacaaaggaagtgtgttggagtggccaccagcacagaagtgtacctttctgggtaatgtgtcacccagtcccctggccatgtgagaggacaggcacagttgccacacagtactaatagttggtctcttctttaagggtcaaaaaaaaggaggtggagcacttttaagaaagtgttaaggttccatgaagatgttatggtggcgtgctggcaggtgcatatcaaccctgccctgaggccctcagcagccttcggtctccccaaagcaatatggctccttataaagaagtcttttagggctgggctcggtagctcatgcctgtaatcccagcactttgggaggccaaggcgggcggatcacaaggtcaggagttcaagaccagcatgatcaatatggtgaaatcccatctttactaaaaattcaaaaattagctgggcgtggtggcgtgcacctgtaatcccagctactcaggaggctgaggcaggagaatcgcttgaacccaggaggcgggggttgcagtgagccgagatcacaccattgcactccagcctggatgacagagcgagactctgtctcaaaaaaaaaaaaaaaaaaaaaatcttttaagtatgccatatgaataaaaaacttttaaaaaatccattacctcaagcatttatcccttgtgttatactcttttagttatttttaaatgtacaattaagttgtgaataaaaactttgagagctttagagtttagaatcactatcacat

SEQ ID NO: 340610 - DNA, 580 bp, Homo sapiens
  misc_feature (443)..(443): n is a, c, g, or t
  misc_feature (446)..(446): n is a, c, g, or t
  misc_feature (448)..(448): n is a, c, g, or t
aatgggaatcgcccacagctcagaaggcagacattgacactgactgttagcacacagctcaaacacaaaacaccaaggttaaaaaaaaaaaatcaatcctttatggcgcaggaatgtgtgcatgagcgcaggtggaggtatctagacacgtcacaccctatgtctaatttttcccttttgggatcaacagttcttttcttgaatcagatatgcactccatttagcatatttatacagaaatcacagcattaggggttcagctttgcaaacatctctctcactttgctaaattaatgacatagttctcacatacagaatgtttctagatgggccatcaccaccgagctgttcccccccgtgtcccccatggtacatgacagtgcaatagcacgctgtccttcagaggacagaaaattaatcaggaaacatttactgggcaaccngcntnactgtgccagggacaggctctggagataaaaagatgagtccaaataaagctttgaatctaaggaaaggaaaaagaaatccaggtagtatttcaatcaaatcatttctcttaaccctttcaaactctctgagg

SEQ ID NO: 340611 - DNA, 394 bp, Homo sapiens
taagcccaaaaaactcaggtcatttcttgcctgtactgttgcaatagcctcataataactagtcttctcctttatcaaccacagtcgtctccgctacacaaagaagagagggtgctaatctaaagtgtaaattattttaaatcagcacccttcttgtaatttcccagtggtttttcctgtcataagaataacatgcaaaattccttgcttgcaaagccaggtatgaccttgccccgtctaccttactggcatcgtctctcatgactcttcccctttttcactctccatcttgccttttcccaaccatgcctgctagtgagccttagcccttgtgttttctctgccagggatgcatgactggcttctttactttattctgatctctctgctcaaa

SEQ ID NO: 340612 - DNA, 411 bp, Homo sapiens
tcattaatcaatgggttcttttaagtaaaaaaacctataatctagattaaatccacagaccatctacattaggaagactaaataacagtgtaattttgaagtcagggggagcctgggattgaactatcccagctacgtgggaggctgaggcaggagaatcacttgaacccgggaggcggacgttgcggtgagccgagatcacgccactgcactccagcctgggcaacaagagcaaaactccgtttccaaaaaaaagactcttccatttctgaccatgaaagagtagctggtatcaaacttgccctcctgccaaagcaaccagaaaactggaaaaaatatatgaaacaactgttttccaacatcgtacacaggcattacagggtaatccctgagagaagggaaacagattag

SEQ ID NO: 340613 - DNA, 439 bp, Homo sapiens
tgtgtccccacccagatctcatcttaaatccccacgtgttgtgggaaggacccagtgggaggtaaatgaatcatggggacaagtctttcccatgctgttcttgtgacagtgaatacgtctcatgagatctgatggttttaaaaagaggaattcccatacacaagctttctctctttgcctgctgccatccatgaaagatgtgacttgctcctccttgccttccatcatgattgtgaggcttccccagccacatggaactgtaagtccagttaaacctctttcttttgtaaattgtaagtttggggtatagctttatcagcatgtgaaaatggactaatatagtaaattggtaccaatagagtgaggtgttgctgaaaagataactgaaaatgtggaagcaactttggaactgggtaacagcagaggttggaacagtttg

SEQ ID NO: 340614 - DNA, 133 bp, Homo sapiens
attcggggttgctttctcttaatttctatagccatttcacaaggcctgtaatgacaggccagctaaagtgcatggaaggcatcatgaataaatcctttcaggaattccattaagggaagactggattccaacc

SEQ ID NO: 340615 - DNA, 376 bp, Homo sapiens
ctactaaatttgggggtaatgtcattcagcaatagataactaatacaaagatgtataagttaatactcaagaatataagcttcttgaaaatagtcgctatgtatttatctttgtatctctgacagcaccatgtccatggtaaagttactcaaatgtttgctcaactgaactgcagttgagtggtaatttttcaagtcatggcttagacactccgtaagcaagggcaaaataatctctgcctgtttcctcacttttacaaactgaattaataatggtgtctacctcgtgggattattgtgaggctcaaatgaaataatacatgtaacattcttagaacaatgccaagcacattaaaaggtgttaaagaaatgttaac

SEQ ID NO: 340616 - DNA, 434 bp, Homo sapiens
tttagacagggtcttgctctgtcacccaggctagagtgcagtggcatgatcttggctcactgcaacctctgcctccagggctcaagcaattctcttgcctcagcttggattagaggtgtgtgccatcacgtctggctaatttttgtatttttagtagagaccgggatcttgccatgttggccaggctggtctcaaactcctgacctcaagtgatccactcgcctcagtctcccaaagcgctgggattacaggcatgagctaccgtggctggctggcttaatggttttttaaatttatttggagggaatgatcgttggttttgggtacatgacagtgatagctatggaggagtaccttgaggcttgggggtcaactgttgcccttggggggcccttgctctcttttctgtgttagtcacaaacccttctattcca

SEQ ID NO: 340617 - DNA, 156 bp, Homo sapiens
gctcctgcaagaggaaggcttttggatttggggcagaggcttgaccagggtctggaagagaaagtggccctaaagagcagtcctccttggaggttgcagtgagctgagatcgcgccactgcactccagcctgggcaacagagtgagactccatctc

SEQ ID NO: 340618 - DNA, 466 bp, Homo sapiens
catttcaaaagctatcaaattttgctcaaattaccaatcatcacctgtagttggcaatgactgctttgaagtttcttataagctaggtccaaccaagggacttctatttctcagtagtacactccacctgggaataatgactttaaatttttaagagactgagtcttactctgcgcccaagctggagtgcagcagcacaatcacagcttactgcaaccactgcagccttgaactcctgggctcaagggatcctcatacttcagcctcccaaatagctgggattacaggtacatgccaccacacctggctaatttttaacattctcgtggagatggggtctcactgtgctgcccaggctggtttcaaactcctggcttcaggtgatcctcccacctcagcctcccacagcactgggattacaggtatgagcctctgcacctggcctgatgttttaaaaagtatgaaa

SEQ ID NO: 340619 - DNA, 612 bp, Homo sapiens
aaaaatggttaagatagtcaatgttatgttatatgtattttaatacaatttttaaattggaaaaaatgtcagtaggggagacagtcacagaagtacaaacactgtatgattccactttatatggaacacctggagtagaaacaaagtagaatgatgtttgccaagggctaggaggagaaaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggtttt

SEQ ID NO: 340620 - DNA, 493 bp, Homo sapiens
acacacacacacacacacaaaatactatatgaatgtggttgccagggaatgtgaggtgggaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggtttt

SEQ ID NO: 340621 - DNA, 845 bp, Homo sapiens
cagatcctgagcactgaggccttggcataggactgttgccaatgaacccagagacaaatccaatgagacctctcagactctagcagcctgtttcttcctactcacagacctaagttaatagagctggtataggttaggaggccaggctctatacagagtattcatttcaggaccagctgtggctagttaataccatagataatagggacgaaacagagggctagatctggagtaagcctgtaaagcttctaaagtgggatatatcatgcccataaccctggccacaagtccaggacaaggaatggtgttctctggaaataaaagctaaaagtctaagaaataaaagctataggtctactgtgagagctttagccacacagtatggaataattttctgtgaagggtccaagaaagtgacagtggtaggctatgagactgtggtctctgaagaacagttcattcatctgttttggtttaggcatagtttactctaagggtacggagggaaggatgggagaaggatacaatgacgcttcacggggtctttgatctataatttacgacagagctgtccgatgtatgtatgcaaaaccccataacaaatcaatgcattttgtagagaaggttggatttttccaggtgggctagtcctgcctctctcccctggctcaacaatgaggaggatatgaggatatgactaacatgaggttctgcagtgccatgaagtgaggaacaagatcctttttggcagatgggtggcacaatcttttttttttttcactcttttgcccaggctgaagtgcagtggtgtgatcaatcacagctcactgtagccttgatctccc

SEQ ID NO: 340622 - DNA, 361 bp, Homo sapiens
attttgtttgactaatgagatcaaacataggttaggattaagaaacagaacctcacaccgtaactgcagaaagtaaatgtcagaacaattctgatgcaaacaatgttcaagttaaaagaatgatgtacacttactgctcttccaaaaacaaagaaggaaaatccatgccagcctgggaaatttgttctgaacagaatatagcatatttagctattctctaccaatctaacttctcttttctctccacccagactaaccccacctcagagtctctacacctatccaatcccattttactgactctacttattttatttcaaaaccccaagaaaatcatgtgcatgataggatgctctcctta

SEQ ID NO: 340623 - DNA, 613 bp, Homo sapiens
gcaatgtaaatgacatacaaggtgaatccatgggataggagaatagaggggcaaaatgagggaagtaaagtgtgaaaaaataaggtaacggagatgatgaagatttgaggctacgtgactgggagaatgaaaatgcccagagctgagaatagaaatgactggaacatgaaaggatgaagtggtgaatggtctggaagaaatattaaaactttgctctgaacatatataatctgaggcatctgaggagccatgtcaattaggagatgccccttgctcacaatcagaaaaggaatgccggagtcaggcagacattcaggattcaacatggaaattttggagtcaccgtcacataagaacaggtaaggacagttcaagcggtgggatcagtaaggtcaaagggatactacaggatgaaaaaattaaaagcaaggcagatattggagaaatacattaagttagtagagtctagaaaagcctttgagggagagacaactaaaggtgagaaagtaaagaaaacaagcaagggaaagtgttcagggctgtagagagagcgagcagattaaagatgcaggatttaccctgaaactagtgtccaggtatctcatcgccacag

SEQ ID NO: 340624 - DNA, 620 bp, Homo sapiens
  misc_feature (107)..(107): n is a, c, g, or t
  misc_feature (135)..(135): n is a, c, g, or t
  misc_feature (144)..(144): n is a, c, g, or t
  misc_feature (151)..(151): n is a, c, g, or t
  misc_feature (163)..(163): n is a, c, g, or t
  misc_feature (177)..(177): n is a, c, g, or t
  misc_feature (199)..(200): n is a, c, g, or t
ttcattacgcaatttacatcactactcagtgaatccattggatacgaaactaagcggctaaatgagggaaataacagtgtgtcacaattaatgtaccggatatgatnaatattttaggctacgttactgggaaanctctaatgnccacatntgagcatacaanctactgacacatcntcggattacatcgtcactgctnngacccacctgtcgaactttgctctgaacatatataatctgaggcatctgaggagccatgtcaattaggagatgccccttgctcacaatcagaaaaggaatgccggagtcaggcagacattcaggattcaacatggaaattttggagtcaccgtcacataagaacaggtaaggacagttcaagcggtgggatcagtaaggtcaaagggatactacaggatgaaaaaattaaaagcaaggcagatattggagaaatacattaagttagtagagtctagaaaagcctttgagggagagacaactaaaggtgagaaagtaaagaaaacaagcaagggaaagtgttcagggctgtagagagagcgagcagattaaagatgcaggatttaccctgaaactagtgtccaggtatctcatcgccacag

SEQ ID NO: 340625 - DNA, 330 bp, Homo sapiens
ccggtgttcaaatttccctaaccatcctaaaggaatgtttagaacagttgtttcattggaaagaaggtcaaaacaaatacattttacatttttaggccagtcttgaaagtaagtgtaaaaccatgtgtggggtaggaggtgggactagactctcaaggtggggcctggataccagacccagttgaggactagctaagacagattccacagtgaataacaccaggaggtgggaatattaaggtccattgtgaaggatggctaccacaattttttgatcaactagttatcaaccctgactgaagctgagagagatttgtttttgcttttttt

SEQ ID NO: 340626 - DNA, 297 bp, Homo sapiens
gaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcttggggaaaatcaaaccatttacagttcatttccattgctgtggcttaggaaatgtcagtgtctgaacagatggagaagtgagatggcagcatgtgca

SEQ ID NO: 340627 - DNA, 178 bp, Homo sapiens
tattccccttcactaagatgcttttggaaaaaatgtggaacagttagtctggttatctaaatgtttattctagttagcagctgaaaagagaatgatgaaaacaatcagctgcttctttttcttcctcttgtgtatcctgtctacagtaatgacaccagtaagtcactcggtggtggag

SEQ ID NO: 340628 - DNA, 798 bp, Homo sapiens
caccaccatgcctgcctgatctttgtgttttcagtagagatggggttttaccaagttggtcaagctggtcttgaactcctggcctcaaatgatccacctacctcggcctcccaaagtgctgggattacaggtgtgagccatcatgcccagcctgcattgtcttaaacggattttatgtgtatcttctacatcttgcttagattctgtgcttactatgtaaccacctgattactattataattcagacttccacattcgcctgctcctagaaaagaagtgtcccaacaaagataggctaggctgtttctagaagggcaggtttattgtagtctgcattgcggaaaactgaactaacatgcttatttctgcaacagtcttttaagagtttggctccagtgaaccagactccatttagatgtggtgccacagaggtggtgcctggccccacgaggtcctgtcccagccatcagaaagccttgtgcactgacagcccttctcttcagagtgcagcctgtgtgtgtgttcttgctatatcaggctaatcagcagagtcccttttggcccaagacgatctccagtgtgcagccgttacccacttcacagagctggctggaggggaaagggcctgggagcataaagccaggagcagaggcaggcatgctagcccagtcttgggcccttccactcagctttattcactccaggatcaagattatgttgagaaggagactgcaggatagcctagcagttaggaacatggacttcgtgttagagaaggctgcttttcatcttgatttg

SEQ ID NO: 340629 - DNA, 512 bp, Homo sapiens
gctatttctgctcagatgacattaaattgaaatatagatttatacttgttttcttcgtgacatagataacatcactgatgtaaataaaccctgtcaaagttgggctcgtttatttaatgacaggagaagatgaattcatagttatttaacttgaagaatcttgaagaactacaaatataaaaattagtcttgagcaaagagcactgcagtatctacagtactagtcccatagcattcttattactgctggaacactatttactacctaattacaatatgtaaatttttttctggtaaatattctttttacattctatatataatgtcgactgctctgtgtatagataatagtattctaatgtcattagttaattctatttacatttttagttgccacttttatcttatgttcttagtgagtttgctaataatgtttgctgatggagtttttttcacttctgttttggaaccatttttatagttaatggaatgctggatttttcaaatttcct

SEQ ID NO: 340630 - DNA, 541 bp, Homo sapiens
gcacagtgacgattcgagagattctggaggacgcatgttgggtgttggtggttttccagttggtatcatagtgtcatattctcttcaattgtaggtttagctctttgggacccaaaaagacaagattagtcaggatagtgacatgcacttggcatgctgtggcttctgttgaggaaaaagtgacccaaatttgaacatccaacttcaattcttagtaattggcaatggctccttgcatctctttctgcttgactataaaactataaaatgctgctattaactttgaaggctgccacttacaaggctaggtgaacagacttttatattaacaactcagactaaccctgggaagcatctgtgctccctaacggagaagttgctttcacgtttttcacggtcaacctgggtggccctcaccatcaggagtgtggaatctcaagagtaacagcacaaaggggtggcaacttgaacccctgggttctagtcccaggtcagctgctaactgctgtatgaactcaaggaagtcatccaatgggatcat

SEQ ID NO: 340631 - DNA, 506 bp, Homo sapiens
ttcagatatgacataatgaaaatggcacattacttctctggtctttctctcccaaacctataaccctagactaatcatgagaaaacacataagaaaaatctcaactgggggacattgcacaaaatacctgatcagtaccccccaaaattgtcatcaaaaagaagaaaatttataatcaagagttgcttaatagctaggtatggtggcatacacctatagtcacagctacttgggaggctgaggtgaaaggctcacttgagcccaggaggtcgaggctgcagcgacctgtgatcacaccgctgcacaccagtctgggtgacgggaagacactgtctcaaagacaagagacagagacacagacagaaacagagagagagagagagacagagacagagagagagaggagttgcccatgaagacatgactattaaatataatgtgatgagcagggcacagtggctcatgcctataatcccagcgctttgggaggccaagtggggaggact

SEQ ID NO: 340632 - DNA, 311 bp, Homo sapiens
gctaagaatctcctcccatttgccttcattctgggtcccgggcctaaaaagtcaaagtacactttgtctggcctggcctagtccagccccttttggagcagagattctagcatattgtcttttcaagcttatagttgggcactggggagaggtatgctagagccagcaggggctgcttagagtcacagaaatcccagtggctttttggaggtgttaacagatggaaagttggagggggctctgtgagccagtcacttctccctgtcttaaaagtctactgtgatgctaagagagaaaccaagtgcagagag

SEQ ID NO: 340633 - DNA, 178 bp, Homo sapiens
ttagttactcaaacaacccttgaaatatttcatttacttaaccaaaaacaaatacttgctgatactttacctagcatcctaagatgttcaggatgtctccctcaatggaactcctggtaaatactgtgtattcaagtaatcatgtgccaaagccagggcagagcttctagttctttgc

SEQ ID NO: 340634 - DNA, 329 bp, Homo sapiens
gctggtctcaaactcttgggctcaagcagtccacctgccttggcctcccaaagtgttgggagttacaggtgtgagccaccgtgcctagcctgaaatgagatcttaaggaaataaaaaagtttcattttggatatattttggggatatttaaataaaaaattttatagatttctaacaaaaatattagtattttgaggtgtaagatgtagaggttatttcctactaacacttgccaacattgacacatctgcatgtctaataacacttaatagaggaggccgaacttcataagaggttaaagcttataccattgcatagtagcacagagt

SEQ ID NO: 340635 - DNA, 369 bp, Homo sapiens
ccaggctggagtgcagtggcgtgatctcggctcacttcgacctctgcctcccaggttcaagcgattctcctgcctcagcctccccagttgctgggattacaggtgcccgccaccatgcctggctaatttggatacatatttttaaaacatcctttgtttactctttaaaaattttaaaattaaaaacccttttttttctatttatagctgctttatcattcatttggcttttccatgacaccacccaagtggctggatattacaagagaacttcagattcatgaccaaaaatccgaagtagacactcagcactgcccggcaaagctaccattgaatcttaataagatctttttgcctatcactatttca

SEQ ID NO: 340636 - DNA, 108 bp, Homo sapiens
gattcgaggagatgaagaggtaggaggagatggtgcccagaaaggccacatccaaagcctggaagcggaatccagggaatttggcatgactgagagcctgtgctgcct

SEQ ID NO: 340637 - DNA, 406 bp, Homo sapiens
ataggaatccaacaacaagaaagcaatcatgtgatggtcttggaggacagctttccagagagaatgagcagttaaagcaaaaatcgtaaggcacagtgtgatcaaggaacagaacaagcagagagtggtgtaggagtaaaaacagaggaaaggtcatggggaaatactcatatttcattccaagcaaaatgggaaggtattttgagagttttaagcagatgagtgacatgaattggtttgtgtttaaaaaaaaaatggtgagttccaattctggaaaagatggagtaagcacaatctaccctgtctctcccactgaatgcaactataaatcatagaatgcactgagctgaagatgaagactcaaaaaataaatgttagaaggtgcctatcaaaagacgagaaactg

SEQ ID NO: 340638 - DNA, 707 bp, Homo sapiens
tgatgcctggtagggggtggatgctgcttttcgagcctctgagtcagcttgggggttccccaaggcaatcgaggtagaagctcgctggtgtcctctgcagtgcatgagccaccttttggggcttccacactgcctctaataattgcaggatctcttgctgatactttatgtcttttctcccagcgttcaacagggctttttccttgtagaatgccccacgcagttggagagttaaaaaggcataccaagagtcagtgtaaatgtttacagtcttaccttcacttagctcaaaggccagaattaaagcaatgagtttggtcttgcgggctgaagtgccctggggcaacgatttggcttcaatgacagcatccaggattaccatatcctacacacctctcttcttgtgggtcgacaaagctgctcccgtccacgtacagctcccagtctactgttgtccaaggatggtctcggaggtcgggcctgctagaataaactgactgcaacacctctacacagttatgttcaacttggctctctgataccaggagcaaggtggcggggttcagggtgttgcaaacttcaatggttatgcggggattctcacagagcaagctttggtacctagttagtctagcattcgttagccagttacgtcctttggtgttcattagtgttaccacagcatggggaggcctttatgttttttc

SEQ ID NO: 340639 - DNA, 521 bp, Homo sapiens
  misc_feature (333)..(333): n is a, c, g, or t
ctcaagtgatccacccacctaaacctcccaaagtgctgggattataggtgtgaaccactgcgccaagccagatgtgtctatttcttttaatctgctagttttaccttcatatattttgaagctccgttattagggtcacaaacctttgtgattgttatatcttcctgatgaattgaccatttttttactatgaagtgtcccttgtagacagctcttttattcattctgacaatctctgatatttaattggaatatttagttcgtttacatttaatgtaattcttatgtatggatttggatacaaatctgttcattcagaaacagagctagacngtctcataaaaaggaaaaaaaaaaatagaaagaggcaagaatgaatgactgaatagtgcttaatctttctaatgaatgattagttacaacctttctggaaaggaaggtttgtgaagatgtctgtattttccaaattaatctgtacatttattgcaattccaatcaaaattgcaattatattttttata

SEQ ID NO: 340640 - DNA, 284 bp, Homo sapiens
aaaaaaaaattagtccactgtaattcacttcagcatttagccagcaaattacttgagtgggaagtaaaaaagatacaaagacaccaaatcctgcttactgcctcagaagattttaagtgggagagacaagtgtgtacataaaaaaattgtaaaacagaattgatataagtccagactacggaaggaaaaaatgatgcgaacactcagctatcagccactaattcctttcggggatgacttcacaggagaggtgaagtttgattctatagatagatgtcagttgc

SEQ ID NO: 340641 - DNA, 277 bp, Homo sapiens
ctgctcaagactcagctacgggtttgagaagctgggagattgaaagaaaggagattttccttcttaagatctgtccacgttcctggacttgaatctgccctttcacttttattatgtctaacaattaaagattgatttggggaatctctgaataccagtctatgtgttcactactcagatctaataatactagcattgggatgtggtattaatatggtttattcttttccggaatgtaggaatgaattgtggaaataactttttttggagacagggt

SEQ ID NO: 340642 - DNA, 561 bp, Homo sapiens
tggctatcaagtatttattgaggtctctgtgtgccctgtgcttacgttgaacagcttgcaatggttcagcagacaaaatagaatgcaagtaaaacaatgagtgatgagataggtgctaagttgtgtagtatagactaggtgatataaaagtgcagaggaaagaggaagaaagaagtcctggtattccttctttaaccatacaacaagtatttactgagtgcttactatgtggtaggggaattttctgtgctctttttggggaatcagtagagagcaaaaatagatacacagaccctaaagtttataggggtgggggaagggagtatgacaaatgaatcaaataattacacaaacatataaacttacaaaaccaagaaaagaaagataaattatgtcatgagatcctacctaaggggattcaactacagttgggatggttagagagggcatcctaagctaaggttttctatgggtatggtttagaatggatgtcagccacaagagtgaaggactggagctgaaacaggtaagtacacatgggacaggaagatcactactctg

SEQ ID NO: 340643 - DNA, 383 bp, Homo sapiens
tgctgaatcattcaatcagttaatatttattgagactttatcccaccccagatactgtgacctatgagggaactatgataattactacaacatacctgtgacccccaagatgtttgctgtcaagagccagacagagatgcagacagacacctgaatgtgaagtgagacatgctgtgggcaaaagattgatgagtcacaggggacggtgctcagttaccgaagagatcaagtgagtcttttttattaattaagaaggtgatcgatgtttgaaaagatgtcaatgataattaattagaccctagcaggttaccatggttaaggactctgtgaagtaatttaactgagacaataaatggtggtgtcagtgctcatgtgaatatcat

SEQ ID NO: 340644 - DNA, 197 bp, Homo sapiens
tatattataataaagtgagttaaagaaaatgttattaagaagatcataaggaagataaaatatatttactattcattaactagaagtagatcctcataaagctcttcatccttatcctttacactgaggaggaagaagcgttgatcttgctgttgtaggggtggcagagggggaagaaaatttgcgtgtaaatggac

SEQ ID NO: 340645 - DNA, 430 bp, Homo sapiens
cccatacatacagacacagagatacaccagacacacacacaatcacacacagacacaccccatacatacagagatacaccagacacacacacaatcacacagacacaccccatacatacagacacagaaatacaccacagacacacaatcagacacatcccatacatacagacacagaaatagaccacacacacacaatcacacagacacaccccatatacacagatacaccacagacacacaatcacagacacacccagacacagagatacaccacagacacacaatcacacagacacaccccatacatacagacacagatacaccacagacacacacaatcatacagacacaccccatacatacacagagatacaccacagacacacacacaatcacacacagacacaccccatacagacacagatac

SEQ ID NO: 340646 - DNA, 576 bp, Homo sapiens
  misc_feature (542)..(542): n is a, c, g, or t
  misc_feature (545)..(546): n is a, c, g, or t
gaataagcctgtaaagaatattctaagcagaaggaaaagtaagagaaggatcctgaggcagggaagagcctggagtggtcaagaagcaacaacaaggccagtgtagcaggagtaggatgtagggatgggagaagaattggagagggagccagagaggttagccgggaccagatgatagaaagccttgggagccacaggaaggagtttgtatttcaagtgggagggaaagccgttctgaggttaacaggcaagactgtggataataggtgctagggtgttaatagtggcaatacagatggtgttgatctggcttgggctggtagcagtagaaattgtcagaagtggactgactgggggttgttctgaagtcaaagctggcagacttgctgatgcattaagtggatgtgcaatgtgaaagaatgggaacggaggcatcatggtgaagcccagtcttttggcccaagcaacgaggtgaacagtgggctatttaccgacattggggaaaactggtagaggatcagattttcatgggggcaggggtnganncggccgcgaatttagtagtagtagtagacc

SEQ ID NO: 340647 - DNA, 450 bp, Homo sapiens
caatgcatactttacaaaactgttaaggatgaagtggtaacacagaagtatttatcacagtgccttgaacattgcagatgccctatcaatgtaaatttcattcttgtcccattttgacaataactgtttgtctaggcttcgcacattattaatttttggagggtgtcatctttcttatttgtaaaatgagaaagtgagaacaaagaactcctagaatgcattttttctctaaatttataaattgtgattcaatttttgtttttaaatttaaaaacattctggtgaaagtagagttgtagatattttaatatggtactaaaacatcaactaatttttactaataatgactgtgtttgggtgtctgataaacagagatgaagcaacaaatgaaacaataaaatacaattataaatgaatatatatatatgtgagacattaataatacatttt

SEQ ID NO: 340648 - DNA, 242 bp, Homo sapiens
tatcatacagctatcaatcatgtcaaaagcttcacagaacattcaagataaaagcatttaattctaggaaaaccaaaaattattagtttaatctaggggctggaaatttaacttattttttattcccttgttccccacaacagtgatcaaatgttttgaaaataaaaatcaacttaacaatggccaagcagacctaattatcttcctctgtttcagtatacttttttttttttttttttttt

SEQ ID NO: 340649 - DNA, 466 bp, Homo sapiens
aatttatacctctaatctagacctagtctctgaattccagacatatattctgctgcctgattgacatctccatgtcaatatttaataggtgtctaaaagttgtcatgtccaaaatggagctcttgatgtttcccaaaatagtaaatcctacagttttcctcatcccagttaatggaaaatcatcatttctctcatacgctgcttccagtctgtcatcaaatccacctcaagtatattcaaaatttgaccacttctcaccagcaccactgtcattatcctgattcaagcctccatcatctctcatcgttactgtgacctcctgatcattctccttgcttcagccctggcccctgcaggcagcattcagtattagcagtagagttgtttctataaaaatgtagtcagctgggtgtggtgtctcacgctgtaatcccagcactttgggaggccaaggtgggaggatcac

SEQ ID NO: 340650 - DNA, 405 bp, Homo sapiens
ttattttgggtggtggaaaaggtgaaaataagacaactgcagacaggactttttaaggaaattgaagttttccataaagcattaaaagctatagaaatataaggtcatatttattcagtcaccattttaagcacctataatatactctgagtagcaccaagtcctggggatacccaagtgcatatactgtcatcacgtggcatccatgaagaattggttccaggatcccctgccaataccaaaatctgcagatgctcaagtcctttatataaaatgtctagtatttgcatgtaacctatgcacatcctcctgtatactttaaatcatctctagattacatatgatatctaataaaatgtaaatactatgtgaataattgttatattttattgtttagggaattac

SEQ ID NO: 340651 - DNA, 232 bp, Homo sapiens
ccgagctgtctcatctgtgttttaccgttctgctctttccggctgcttgtagttagaagagaagtgatttcctggaaatgcatggggctagaaagggagctgaaacataaattagcggtgtttatccaagatgacgatgctcctgctttgtcaggtttgcttcctgtccctgccagttattagctaggaaacgtggggaaaattgcttagcttttccaaactccatctttaa

SEQ ID NO: 340652 - DNA, 377 bp, Homo sapiens
tcatcctgcatttgtgtgtcctgctgcctctgtctgggctgccttggacagtccccctttttgcctggtgacttcctttccagctcttaaggcctgttccagtgctccccgcaactcagtgtgttctccggccaagcccagcttacctggacttcagcaacactttcctgcctcttgcagttgccccagcttcctgggctgaccttccagagcacttgttaccccatcctccactgaaacaatgcccagacttgtctctccggcctgaatgagtatcatgacctctcctcattcatccctggcaccctggcacctggcacagaatgtggcaccactaggggcttaggagatgggaactgaatgaagaaatgtagaca

SEQ ID NO: 340653 - DNA, 629 bp, Homo sapiens
gcatgggccactgcactcagccaacacctatccttgaggaatagaaagatccaggctccacaccacacaccatcactgactcaagtggctgttctgattcccagctgagcctgaggggttcggggaggtaatctctgaggtcctcactgctgggccgtgcctgggcatggcctcttcctgcaattttccaactaaactctccgggggggctcagcgccatggggtggttcgaagaaccatgatgaaggctggttcgaattgtgatgaccatttttgtccacatctcctaggacccataagccagagtttctctggagcttatagctagaaggggttctgggtcctggagtgcaggcctgtcaactttacaggagagcactagattgctttctgaagtggctgaaccaggttatgcttccatcagctgtgtatgagcatccccatcttcttgaccacacttgaagccatcagtttccttgaagcatatgggttgcacacttcattttgcatgtatcaaatttatataataaaaaatgtaaggaagccatggaaataaaaacataggtgtgccttctgtaggctgctacgctcctgtgcacgagggcgtctagaactttgccctccatgca

SEQ ID NO: 340654 - DNA, 370 bp, Homo sapiens
cctaaccacgcctctatgagtagcgccttcattaaaatctttagcactttcggacccatagatacagaagggaccaccttcctatagcaggacactgatcctcttctaccccaggacaggaccaggaagtattatgttaggattgctctgaaatctcaagtccttggagttggaacttttagaggccttctcccctctcctggactcaccaacccaggcactgtgtctattgcaagctcctctaggctgaaattacctggagaagcatcacagcaggtactctctgttccaggaaacagaaggtagcccagattgtttgagaactgctgacatccacagatcctcacagttaggttaaaaattgttgaaa

SEQ ID NO: 340655 - DNA, 391 bp, Homo sapiens
gccagaaagaagtttctcagtaggagactagaagccattattaagctgcatttagtgacctcacatttcagcccacggttgttaaggaagaacaaggggagctgcttcttgatctgcaaagggtctctcccacccatccctgctgctttcaccccctccctcattccttatgggatgtccagttgttctttgtgtataaacagaaggcaggggttggggcagcatatgactcttcctcctatgttctggaggagggtcttagggtcagaaggtggcctggaagtgtatatctaagtcagatggtctgtagagaagcagagtgagttcatatgctcctctgggacaaaataagcagaccacacattgcacctgcaagtatagtcatcagcaa

SEQ ID NO: 340656 - DNA, 1281 bp, Homo sapiens
atcattgtggtaaggattaagagattggttggtgtgcggaaacattgtgagcagcttggatgaaaagatgacctggccgcacgtggtggctcatgcctgtaatcccagaactttgtgaggctgaagcgggtggatcacaaggtcaggagttcaagaccagcctggccaagatggtgaaaccccgtctctactaaaaatacaaaaattagccaggtgtggaggcgggcgcctataatcccagctactcagtaggctgaggcagagaattgcttgagcctgggaggcggaggttgcagtgaactgagattgcaccactgcactccagtctgggcaacagagcgagactccgtctcaaaaaataataataataaataaataaaagaatgacctgactgtggactggaagggtctggaattgctaaagatgagcccctgaggtattgctgccatgagttccagattcgtgtcagtttttttggcacccacagcaggaactggggacctttgtgattcctggtttgtcatttttcctggtgactacagagtggagagtcttacgtcttcagcaagacttggatgttgtattggacagctgtgcctcgtatgtagttaaggagacagcacagttcaccgcacaaagagagtgtctccatccttgggtttataagcttcacacttcagtttttctttcctatgcctcttctgcatacaaagcagtggacttccattaaactttgtgaggtgacattttcctaggtccaaggagggagcctagtctagtggcagtagcccggggctcagctctctcaacagaaatccattcccagcttgtctctgacctcaatagggaaattccaagggatttgtccatttttttttccacattctctcttaccagatctccccagagaagcccattgtcaggcttgggctgggaatccagtgagtcactacgcagaggttttgctgacttactggctgagggcaggatgatacattgagaagagattgcttacaggaatgaatacaacactttgtgaggaaagaggggcgctaactaccattacaggcagaattagatccatttgcatctgccccctgcatggcctctccaacggggccatgaatatgctggaggtgtttgtgtctagcctggaggagtttcagccagacctggtggtcctttctggattgcacatgatggagggacaaagcaaggagctccagaggaagagactcttggaggtaatggcactgttacagaatttcacagatctcagc

SEQ ID NO: 340657 - DNA, 307 bp, Homo sapiens
aggtggacgttattgttatcctcattttgcagatgaggaatgcgaggctcagagaggaaacataacttgtccaaagtcacccacaagtatttagcagagcctaaatttgaagagtcagtttgacttgaaaacaaattgtatcacacatataaatggattcaccttttataagactgtaagttctttgcaggcagaaatgggtctcatgggttgtttttcacttttgcacaaagctgtaagctttattgctatatattaagcaaacatgtattgtctaagtaattcagatgcattctgtcacactatt

SEQ ID NO: 340658 - DNA, 338 bp, Homo sapiens
tgttaagagcaatgacttgggaagaaagggcttagcttgaaggtgggacgtcgcaattgggttttgtcacccattaaaataaagtgagctactgagaccaatgaccgctaacattctataaatctatgatcacacaatgatatacagtagtcccccattatccttgagggatacatttcaagactcccagcagaagcctgaaatcatggatagtactgaactctatatatactgtgttcttcctatacaaacagatttccaaatttataaatccgacacagtaaaagattaacaacaataattaacagaacaattttaacactatgtcagcatcacta

SEQ ID NO: 340659 - DNA, 157 bp, Homo sapiens
caaatcaaactcagagtaatagaaaagaaatatttaacacaaactaataattaaaacacaaatttcacctattgttcaggatatctttttgagaaaggtttttgttaaagaaaatttcagatacaaacataaagaaaattaaacaatcaatccccat

SEQ ID NO: 340660 - DNA, 566 bp, Homo sapiens
  misc_feature (560)..(563): n is a, c, g, or t
tgtggtgtcgcacacctgtggtcccagctactcgggaggctgaggcaggagaatcacttgaacccgggaggcggaggttgcagtgagctgagattgcaccactgcactccagcctaggtgaaagagtaagactccgtctctaaaataaaataaaatagaataaacaattcaaaattccttttctcggttgcaccagccacgtctcaaacactgaacagccacgtgtggccactggctactgtattgaacagcagatgcgtaggcattcccagcactgtggagcgctttatagcccacatgtacccgttcttagatcttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340661 - DNA, 986 bp, Homo sapiens
cgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggtatgttttcaacatattatt

SEQ ID NO: 340662 - DNA, 543 bp, Homo sapiens
ggaataaatatggaaacattcataaaaatcttttatttttattgatttaagccagtttgtaacatttgtattttcttagatttttaaaaaaatctaagacatttgaatgaaccatttatattaaaaatatgtgacttttggccaggtgtggtggctcacacctgtaatcccagcactttgggaggccgaggcaggtggatcatgaggtcaggagatcgagaccatcctggctaacactgtgaaacccgtctctactgaaaaaaatacaaaaaattagccgggcgtggcggcgggcgcctgtagtcccagctactcgggaggctgaggcaggagaatggtgtgaacccaggaggcggagcttgcagtgagcggagatgtgccaccgcactccagcctggacgacagagtgagactccgtttcaaaaacaaacaaacaaaatatatgtgtgtgtgtgtgtgtgtgtgtgtgtgtgtgtgtgtgtgtgacctttttgatgatgacttaagagcatttgtatttgaggtgaaaagagatcagtctgt

SEQ ID NO: 340663 - DNA, 392 bp, Homo sapiens
  misc_feature (386)..(389): n is a, c, g, or t
cctccccaactcctggcacccaccattttactttctgtccctatgaatgtgatggctctagggacctcctctgagtggaatcagacagcattttccttttttgactggcttatttcactgagccaagtgcggtggcacacgcttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340664 - DNA, 3954 bp, Homo sapiens
  misc_feature (1970)..(1970): n is a, c, g, or t
  misc_feature (2061)..(2061): n is a, c, g, or t
  misc_feature (3584)..(3584): n is a, c, g, or t
  misc_feature (3948)..(3951): n is a, c, g, or t
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgnagatctcttagagaggaagggacttgatatttgttgctaagcactttcccaccctgttgttatcctcatcctgaggatgagaaaccaaggntggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggctagagatgactgccctttagagcaggttaggttgcctaggctttagcttggtcctatagaaaattagggagcctatactgtttctagaatttttatgcccattttaggggacttgtagcatatacttaatatgtcctcacttaacattgttgatatgttcttggaaactgcaactttaatgtcgtataacaaaaccgttttttcttctcatcatttcaagaaaacaatgttgaagtttatttgaagacctgctgtacatctgtattagtccattctcatgctgctataaagaaatacttgagactgggtaatttataatgaaaagaggtttaattgactcacagttccatgtggctggggaggcctcaggaaacttacaatcatagtggaaggcacctcttcagagggtggcaggagcaagaatgagaggatgagtgaaggaggaagccccttataaaaccatcacatctcatgagaactcactgtcacaagaacagcatggggaccgtcccccataatctaatcacctcccacgaggtccctccatgacacgtggggattgtgggaactacaagatgagatttgggtgggggcacagccaaaccgtatcaacatcatttcacttaaagtccgtgtccaagaacctatcaaggacatttgaggacttactatatttagtattcttaatgctgtgtttataatcaatgtatctgcttatatctgttgccatgttcagtgattactaaacggcaggtacttagtcagaacgtaaatcccagttatggtttccccaggaggaaactgatgtgctctgtgagtttccacttggagtgcacagtgagagggactggagaccacctgcatttcctgctgatgcacccaaatttgtactattattttgtaggatacagaagtggtttttcatttctcaataggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctagtctcgctctgtcgtccaggctggagtccaatgctgcgatcttggatcactgcaacctctgcctgctgggtttaagcgattctcatgcctcagcctcctgagtngctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340665 - DNA, 2395 bp, Homo sapiens
cgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctgtaatcccagcacttgggaggccttgggaggccaaggcacatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctcaaa

SEQ ID NO: 340666 - DNA, 2218 bp, Homo sapiens
cgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtgcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctgtaatcccagcacttgggaggccttgggaggccaaggcacatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctcaaa

SEQ ID NO: 340667 - DNA, 2452 bp, Homo sapiens
cgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggggccattctaagtatatgtgctgccgcatcgagcactgttcagtcttcttaaccaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctgtaatcccagcacttgggaggccttgggaggccaaggcacatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctcaaa

SEQ ID NO: 340668 - DNA, 2442 bp, Homo sapiens
  misc_feature (2072)..(2072): n is a, c, g, or t
  misc_feature (2436)..(2439): n is a, c, g, or t
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctagtttctcatcccagtttccccagcctcctgtgaaggtgtcagagaaagaagatagccctctcttcatgtgctttctgaactctgccttttcagtgggcagaggaagtgctttgtagcagcaaacccaacccctgagcctccatgtgtcgggtcaggcaaaatgaaattgacacaggctggaattttactgatttcagtcattgctgggctcgtttgtgcaaatagactcagaagagctcctttaaaaggagtgaccatttcctgatttagattctgagggggtttttggttttttttactgttgttcactatcatgagcttaccatgtgcttttttcttttttttttcttgtgatgtagtctcgctctgtcgtccaggctggagtccaatgctgcgatcttggatcactgcaacctctgcctgctgggtttaagcgattctcatgcctcagcctcctgagtngctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340669 - DNA, 450 bp, Homo sapiens
tcagtctgtaaaatggtttcacaagaatgtgaaactatttgtaatgagcattttctgcttgctgtattttcaggcctttttcttggtctatgctctgggatgtttaagtatttactatgagaaggtaagatgctttgtttacatacaacccacttaaaatttccctgttgttaaaagcaggttgtactaatttctatattgcattaatacaaatgtttctactcttactgaataaaataggaattgaatttttctctaaagttttggatttgggtcctgaggtgggactgttcgagcaaaaggcatctttgacccttttagattgcatttcattcctcaaaactaggagaagtacagtatcttgtactggataatgattaggaaatctgtgtcagaacagtattaaaaattaacaaaaataaaagttacccgtatttggcacctactatg

SEQ ID NO: 340670 - DNA, 2148 bp, Homo sapiens
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattgg

SEQ ID NO: 340671 - DNA, 2500 bp, Homo sapiens
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctgtaatcccagcacttgggaggccttgggaggccaaggcacatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctcaaa

SEQ ID NO: 340672 - DNA, 2575 bp, Homo sapiens
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtgcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctgtaatcccagcacttgggaggccttgggaggccaaggcacatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctcaaa

SEQ ID NO: 340673 - DNA, 4138 bp, Homo sapiens
  misc_feature (1796)..(1796): n is a, c, g, or t
  misc_feature (1887)..(1887): n is a, c, g, or t
  misc_feature (3768)..(3768): n is a, c, g, or t
  misc_feature (4132)..(4135): n is a, c, g, or t
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgnagatctcttagagaggaagggacttgatatttgttgctaagcactttcccaccctgttgttatcctcatcctgaggatgagaaaccaaggntggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggctagagatgactgccctttagagcaggttaggttgcctaggctttagcttggtcctatagaaaattagggagcctatactgtttctagaatttttatgcccattttaggggacttgtagcatatacttaatatgtcctcacttaacattgttgatatgttcttggaaactgcaactttaatgtcgtataacaaaaccgttttttcttctcatcatttcaagaaaacaatgttgaagtttatttgaagacctgctgtacatctgtattagtccattctcatgctgctataaagaaatacttgagactgggtaatttataatgaaaagaggtttaattgactcacagttccatgtggctggggaggcctcaggaaacttacaatcatagtggaaggcacctcttcagagggtggcaggagcaagaatgagaggatgagtgaaggaggaagccccttataaaaccatcacatctcatgagaactcactgtcacaagaacagcatggggaccgtcccccataatctaatcacctcccacgaggtccctccatgacacgtggggattgtgggaactacaagatgagatttgggtgggggcacagccaaaccgtatcaacatcatttcacttaaagtccgtgtccaagaacctatcaaggacatttgaggacttactatatttagtattcttaatgctgtgtttataatcaatgtatctgcttatatctgttgccatgttcagtgattactaaacggcaggtacttagtcagaacgtaaatcccagttatggtttccccaggaggaaactgatgtgctctgtgagtttccacttggagtgcacagtgagagggactggagaccacctgcatttcctgctgatgcacccaaatttgtactattattttgtaggatacagaagtggtttttcatttctcaataggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctagtttctcatcccagtttccccagcctcctgtgaaggtgtcagagaaagaagatagccctctcttcatgtgctttctgaactctgccttttcagtgggcagaggaagtgctttgtagcagcaaacccaacccctgagcctccatgtgtcgggtcaggcaaaatgaaattgacacaggctggaattttactgatttcagtcattgctgggctcgtttgtgcaaatagactcagaagagctcctttaaaaggagtgaccatttcctgatttagattctgagggggtttttggttttttttactgttgttcactatcatgagcttaccatgtgcttttttcttttttttttcttgtgatgtagtctcgctctgtcgtccaggctggagtccaatgctgcgatcttggatcactgcaacctctgcctgctgggtttaagcgattctcatgcctcagcctcctgagtngctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340674 - DNA, 3668 bp, Homo sapiens
  misc_feature (1796)..(1796): n is a, c, g, or t
  misc_feature (1887)..(1887): n is a, c, g, or t
  misc_feature (3298)..(3298): n is a, c, g, or t
  misc_feature (3662)..(3665): n is a, c, g, or t
cgttgccggggtaacggcgagcgcgtggggccaagaaagggcctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgnagatctcttagagaggaagggacttgatatttgttgctaagcactttcccaccctgttgttatcctcatcctgaggatgagaaaccaaggntggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggctagagatgactgccctttagagcaggttaggttgcctaggctttagcttggtcctatagaaaattagggagcctatactgtttctagaatttttatgcccattttaggggacttgtagcatatacttaatatgtcctcacttaacattgttgatatgttcttggaaactgcaactttaatgtcgtataacaaaaccgttttttcttctcatcatttcaagaaaacaatgttgaagtttatttgaagacctgctgtacatctgtattagtccattctcatgctgctataaagaaatacttgagactgggtaatttataatgaaaagaggtttaattgactcacagttccatgtggctggggaggcctcaggaaacttacaatcatagtggaaggcacctcttcagagggtggcaggagcaagaatgagaggatgagtgaaggaggaagccccttataaaaccatcacatctcatgagaactcactgtcacaagaacagcatggggaccgtcccccataatctaatcacctcccacgaggtccctccatgacacgtggggattgtgggaactacaagatgagatttgggtgggggcacagccaaaccgtatcaacatcatttcacttaaagtccgtgtccaagaacctatcaaggacatttgaggacttactatatttagtattcttaatgctgtgtttataatcaatgtatctgcttatatctgttgccatgttcagtgattactaaacggcaggtacttagtcagaacgtaaatcccagttatggtttccccaggaggaaactgatgtgctctgtgagtttccacttggagtgcacagtgagagggactggagaccacctgcatttcctgctgatgcacccaaatttgtactattattttgtaggatacagaagtggtttttcatttctcaataggaacttatgctgtgctatttgattaaaccctctactatgactgacaaggaaatggagtcaccagaatgtatgaaaaggattaaagttcagtctcgctctgtcgtccaggctggagtccaatgctgcgatcttggatcactgcaacctctgcctgctgggtttaagcgattctcatgcctcagcctcctgagtngctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccactttaaannnnaaa

SEQ ID NO: 340675 - DNA, 271 bp, Homo sapiens
gatgctcagtaagtctttgctagccttatgaaatctttattgattatcctgctagcttgaaagctgtattccattagtgtcacatgtgagtgttgaggtaaagacaagaggaaggatacaaacaagcaccctggtggtctgggactctctttccaacatactctaaaacaaaatatagaggcatcagacatttggagccttcatctagtgaaaattctgcagctccagtaagtgctgcaatgtgcctgtgcaatccacatcgtctgccact

SEQ ID NO: 340676 - DNA, 103 bp, Homo sapiens
aaattatcatactccacaaagcatcgtgtgcccccctggagaggagtgaccctcaccaagtgactgacacatcaagcaagagattcaccaagtccccgagggt

SEQ ID NO: 340677 - DNA, 107 bp, Homo sapiens
atgaaaaggaaacagcaaggaaattaaatgcctgagtaaggtgcaaaccagagaataagagtccccagaaaaactcaagattctgcaaccatggttaagtttcagag

SEQ ID NO: 340678 - DNA, 763 bp, Homo sapiens
tgactcaggaggctgaggtgggaggatcacttgaatccaggagtttgagaccagcctgggcaacatagtgagacctcatatctacaaaaaagaataatagcaaaaaaagcaaaatcagctgggcatggtggtacacacctgtagtcccaactactcaggtggctgaggtgggagcatcatttgagcctgggaggaaggggctgcagtgagcagagattgcaccactgcactccagccagggtgacattgtgagaccatgtctcaaagggaaaaaaaattacatatattttttcctttttttgatatagatacgatatttttctcttctgttcattggtaggttggatctctgatgtgtgccataggggcaaaactttaggcaaggaagagagaaggttttgtgtcctgattctgctcctctctttgtcacttggtctgagtgttattacttagaccctaatagcatcatcaccctgcgtgctcttggaattagtcccagttttgcagtcacagatagctaagcagttggcaccaaaattccatggagcgacatcgtctcatctttattctaggtattttgcaagagtgtagcagccctagagctacatgtttgtgtgataaaactaggaaaggtagcaaggtagaactttttagggagtagaaagtttcagagccactctgcattgaaattacttacctgctttttttctcttgtttaactttattcagtgactttttgcatacagaggagcttactttctag

SEQ ID NO: 340679 - DNA, 151 bp, Homo sapiens
tgagcggagcgaggagaggaggggtggagagggaggaattcccagtttccctagaatgggagggaatctgacagggagatgaatgtcctggaaaaaagcgctgtctttgcctgacagaccctggggcctgtcctggctcagtcactctctt

SEQ ID NO: 340680 - DNA, 227 bp, Homo sapiens
tccttttcccatatacccacatacctgggaaaaatcaactttttctcagatactctagcgcaaaggccaactcaaagttcagcttttccaagaagccttcttaaattcgacctaggaaagcatagtttcctcaatgtttccagataagggcacagcagtagaataaaggcacaatataaagaactcaccgaacagcagctcccggcgcatcatcctcctgactgtgg

SEQ ID NO: 340681 - DNA, 202 bp, Homo sapiens
tccttttcccatatacccacatacctgggaaaaatcaactttttctcagatactctagcgcaaaggccaactcaaagttcagcttttccaagaagccttcttaaattcgacctaggaaagcatagtttcctcaaaccttgcgtgtggagtataatcacctcacatatttgcattttctttttatttttttaacctatcatct

SEQ ID NO: 340682 - DNA, 529 bp, Homo sapiens
tcacacctgtaatcccagcactttgggaggccaaggcaggcagatcacttgaggccaggagttcaagaccagcctggccaacatagtgaaaccctgtctctacaaaaaatacaaaacttagccaggcatggtggtgcatgcctgtaatcccagctacttgggaggttgaggagggaggatcacttgaacctgggaggttgaggctgcagtgagccgagattatgccactgcactccagcctgggcgatagaatgagaccctgtctcaaagaaaaaaaaaaagtcttgggattagtgcagacagggagtccttacaaaagatattgtggaataattgcttatgaagatgctgattttgcaagaaagggtaatggacacccgggccaaacctagtattcaaagcaagcagtctcaaatgcaaaaagtgctggttgtcatatggtttagggataaaaatactgtggtatttttactttattctttaatcacagataggcccaagagatcctcgagtttatgcccaaatctct

SEQ ID NO: 340683 - DNA, 655 bp, Homo sapiens
acatatgtttatagcacacaattcgcaatgtaaaatatggaaccaatctaaaagcccatcaactaacaagtggataaagaaaatgtgctatatatacaccgtggaatactgctcagctataaaaacgaatgaaataatgtattttgcagcaacttggatggagctggaggccattattttaagtgaagtaactcaggaatgaataaccaaatatcgaatgttctcataagtcggagctaaggtatgaggttgcaaaggactccagggggaaatttggaagggggttgagagataaaagagtatatatcgggtacagtatatagtactccggtggtaggtgcactaaaatttcagaaatcaccactaaagaacttatccatgtagtcaaaaaccacctgtagccccaaaactattgaaataaaaaaaataaaaataaatcttcacgatggttcataagtcttcttcgctatggtccataagggtatcatgatgaggcctataggcctccaaccttatccccaaactccagctgccattcttctgcagctcacctgaccctatcttccttgagcataccaagctctctcccacttaaggaccttggtgcttcattccatcagctgaaatgatcagcaccttgcatggctgcctcctc

SEQ ID NO: 340684 - DNA, 220 bp, Homo sapiens
tgctgccttgatgttttattgttttgtttgttgccctcacaccttttgtctggactttatgttgacaagtgtgatggagaagggccttggggttgtgagttttatcccaggacttaaatggaaccagagagttcccatgtgcttctgaggttgctcaaagctcagagttccattggcctggtgtgttttatgtggtggcagcctgggtattggtagcaat

SEQ ID NO: 340685 - DNA, 177 bp, Homo sapiens
taaatatatgaaatgttgcttgatttttattagttattaagaaaatacaacttaaaaccacaatggaatacaattagacactgaccagaatggctaaaatgcagaagaggcaatatcaagtgttgaggatgtggagtaactagaattcgtcgacattggtgttaggattatatattg

SEQ ID NO: 340686 - DNA, 810 bp, Homo sapiens
aagccacaagacgggatgagaatatcaggatagtgtgaacagatagaaagaaggctgggatcactccaatgctgcaagcaaacagaagagaagcaaacagaaaaggggactgaaaagactgatgcgtgagacaggaggagaactgggagagtagggagccctggaagccaagcgaagtaagtgtgccaagaaggggaatgatcagccatgccaaacactactgacgggtgaagtaaggggaggactgcaaactgacttgagggatttaggaacttggagggtattggtgaccttgacaagagtggctttggagaaaagtgacagtgaggacctgaagggagcggctttaaaaaaaaacaggagcaaggaattgaagacagtgagcactgacaactcttcaaattgtttttgctgcaaagggggcaaagaaattgtgcagtagccagcaggagaagttgcatcaagaaaatatgaaagaaatctcagaatgtttgatgctgatgggaataatccagtagagagtgaaaactggtgctacaggagaggtggggagagctgcttatgaattagctgaggagggaagaaggattgagatcttttgtgtggatggagagatcagctttgggcaggatccaggcgagttcatcttggtaaggtgacagaaggcagaatctgtgtgtgtgatgtgatcatagtgggccatagccaaataacaataatggtaatcagtcagaccaatattgtttcctaggaatgggaagggaagagcctttaacgtaggaagaaaccatcccgatctttaaatttctg

SEQ ID NO: 340687 - DNA, 94 bp, Homo sapiens
cccaccacctgtgaacagagttcaggcctccaccattcccccaggggaggaaccctgcatcacccttccaagactgggggacttatggggaatg

SEQ ID NO: 340688 - DNA, 781 bp, Homo sapiens
gccccatggaaagcctcaatctccccacctgtttcttgatgcttcctgcccttgaagggcagctggtgggggtacttagagagacaggcgctagcatgacagagctggtctgtcagcccccttcctccaggaagtcttccaaaacagccctcagccccctctgcctcggcagaacttgcagtgctggggatttggcgggtggccacgtgccgccttgtggcagccagcagtatgcctggagcccagggaagactcagtgtttgtcaaaccgaaccaacatggtgccggcacttctctccccacgtgctcctgtctcctgctctgcgacacaggcctcacaaccaatcctctgactcccaggccctcgtgcagctgatggggaagaagccctggccccacaggcagatgggggtggggagcaaacaagtccctccccctctttgaggctccatccttcttcctgaaatgggaataacgccagctcttattgacgagggtgagccatcgtgtatactaagtgctcatccctggaaggcagccatcagaataataattgtcattgttaccatcaccagtgtcagtcagggtccagtcgagagacagaaactgtaccgttcagataaacagagaaattttggtatagagaattagaccaggcacggtggctcatgcctgtaatcccaacactttgggaggctaaggcaggaggatggcttgagcccaggagttcgagaccagcctgggcaacgtgggaaaacctggtctctatgaaaaaatacaa

SEQ ID NO: 340689 - DNA, 365 bp, Homo sapiens
ttgctagaaatgcatcagaaacaaaataaccattcgcggaaccaagtaaaagccttccactaggaactaaaaaatatcatggttttttatatatatgcatacacaagcaaagccagaggagaataaacagcaaatgaatgaaaactagaagcaaaaacaaacaggaaaccaaccctaaattttcctatttaatttaccctggaggctacagtgttacctagggccccagaaaactcacataatgaatattttattcctgatacacaatttaatatcctttagtttaccagtgtggagagagagtgtggagagggccagtgtggagagagagtgtggagagaccagtgtggagagagagtgtggag

SEQ ID NO: 340690 - DNA, 340 bp, Homo sapiens
acacatcccacatcttttgaaccttcctccgatgtaacttccggttccttcagtgtcctgatctctcttctctgaaaggggatcggtcatctctcttcctccaggcagagcctgggtgcagtacagatccactcatccgccatagggagagcctggtcggtttctagctgaaatccagatacactttgaacaccacgttttccttcctaaggagtagatgctagtgtcatgagatttgttcttaatgaccttcttgccagagaaggcagaagccacatttagaaattctactttctgtctattaaggatgtaatatcataccatctgctccaacagcagt

SEQ ID NO: 340691 - DNA, 519 bp, Homo sapiens
cattaaataaatgtataaaataaacaagaatgagggaatgcttcaccagttaatttacaatcacatattgagtacctttaataagcccagtgttaactgctatagagcacatgggtaaaacataagatgggcaaaacattcttagtgaaaaagggagttctgaggtcaaacgtgtttgggaaatgcaaggtggacaaggctaaaataggtttcttcgcaggaagaattctcagagcctttaataggtcaatatgcattgcaaatctctgagggggaagagattaggcagcgcttctcaaatttacttgaccggaaaactcttgttttacaaagttccccttattgcctacagaaacacttggacaagagaatacatatcaaatatatgatgtacttcaatcaaagagcttataatcttgttggggaagcaaagcttataaatacgcataaaacaaagattacgtggtggctcatggccataatcccagtgctttgggaggccaaggcaggaagatcact

SEQ ID NO: 340692 - DNA, 145 bp, Homo sapiens
gactgtattgtcatatctctttgtctgtctctatttcctgtttcttttccataatagtaaaactcaacttttcctccccaaacaaggaaactacaagaaaggacttggatttgcctgctccttctgcctcctattgtcatgcttc

SEQ ID NO: 340693 - DNA, 570 bp, Homo sapiens
ctcgtttttgggaaaataattcacaaatggtgttcctgagaaaggtaggacaacactttcataaattttttagttatgcaaatccctgaaccccacctctagaggtggagacatggggagagctgcagcagggtacatagaagtatagcaattgtttttccaaatcatcacttattgttccagatcaatttcattcaaagccttccctaatgtgattttcaagaaagttaaaccaggcatcctttattgcaagatccaggtaagacaggaaaaaaggtcaagaaatgccaatgtctggttgaatagacatttttgtttttttaacatgattaacccttattaaaaacttgagattactttcaagagggaaggtatttcaaacatactcaaggcttttccaaaacagttctgaatcaaatttaagcacaagtacctaaaattctgaaaagaggcacgcaacaataacttttagcctaactgaacatgagttacaccccacgtatgtgcaggcttcatgtacaaattctcttctgatacttctaaacgggtatcagcttgaaaattattcaa

SEQ ID NO: 340694 - DNA, 240 bp, Homo sapiens
aataactgtaatgagaggagaagatcatgagggaaaaaaaaaaaaaccttgaagtgacctgaacaccttcctggtttgagaagattagaagaagaatctctatcaggaccagtcttcagccataggggttctgcttctcggcttctataaacaaccagacaaatagtgacggccaaagaaactgtagggaattcatagaatttgtaaaaacttgaaaaattaaatcctacatttagaccc

SEQ ID NO: 340695 - DNA, 862 bp, Homo sapiens
aataactgtaatgagaggagaagatcatgagggaaaaaaaaaaaaaccttgaagtgacctgaacaccttcctggtttgagaagattagaagaagaatctctatcaggaccagtcttcagccataggggttctgcttctcggcttctataaacaaccagacaaatagtgacggccaaagaaactgtagggaattcatagaatttgtaaaaacttgaaaaattaaatcctacatttagacccagatctcttaacattatttatgttatgaaataatagtaatagtaaaggaagagtacaagagcaaaacaacagatatatcctactgaagtaacttatgattcactttctactaaaagtatatagaaaaatgtagtgttgaattaggaacactgtacaggaaaaaaatggataaacctagtttttaaacacattttcaccttgtttgtctgacaaataaaagaaaaatagaaaagtgtatctgataccacatcttagattttaatctggaaaaatcaaatactaaactgagatctttgagcttacctggtccagataaagaaattaaagtccagaggaaaaaatcattttgtcaagggcacatctctagagatggaagttagatggagagctagaacgagaacctgttgtggtctcacttccagataatgttttcaaccacaataccacaatatcactgcctatatttatagttcccatggctttttctgctctttttcttgttacgtatggaatattaagagataccatcacaagtctcttgtctaagaagaaaggcaagaataacagctacaatttctttggaaatacactgttaaactgagtctcatttttgcaagattgc

SEQ ID NO: 340696 - DNA, 658 bp, Homo sapiens
ataggacttttgtgaggattaaataaaggaatacactgtacatacagtgcttacaggtgcttcttccacaaggaatgggcagtacactttaagtattatttatatttctgatatcccaacagttaacactaaaccgtaccaagtatacattattttgctctctctcacacaaatatacacatatataaacaagtcacacagtcccaaccctgaaggtcaacgaggatagtgtttgctacccttgtagagtacaatctttaaactgtgatgacaagacaataaattttcccaaccatttgaatgagctttggaagtggattttttacttgagcttccagaaaaaaagcccagtctggctgatgccttgagttagccttatgagcattgaagcagagaacccagttgagcctgactgaattagtaactatagaaatgtacactaagaaatgaaggttgattttggccaaaaaataataataataatggtaactgtgataatgtgaactggcatcctctcccccacttacagcagacttgaggttaatctagagaatgaattttgggctagaagaaatcatccagtccacaatcagtgtcttcaattctagaatcaattgaaatatttgcttatcatcaaaataacattttcttcaaggca

SEQ ID NO: 340697 - DNA, 436 bp, Homo sapiens
catttctcttccacatgataatccttccctccttcaatcaacccttcttttttccaggctaaacatctccatttaattcattcattctcccacaacatggtttccagttctttctccatcctattcactcttctaatggcagaatccatcatgagtatgtgctctgaccacctaacacagtgtcctgtatatttattcattcaacatagacttagtgacaccaggtattgatattattctaggaattggagatatatcagtgacaaaaatcactgctatcttaaagcttaacatctcatctagcacctagaacaaggccagacacaaagtaagcactcactaaatacttgttgaaaacatcctgcacgaagggcagtatctgaatttgaacacaatgattccaaatgtggttgaacatgttgaaagtggcacactc

SEQ ID NO: 340698 - DNA, 388 bp, Homo sapiens
ttactcccactgctctcctgaaattgctttctcaaatgtcaaagtaccaccagttgattcaattcttccctcccagacttctctgcaacacccttgaaaatgccctccttgaaaagctctctatccttggtatgttctccacactgtggcaactcgagacttttcttcacctctctgacagttcctttcatcttctttgttcttgctccctaaagtaagattctttaaggctttctttgctctctgtgtacaaccttcttgtagaattgggtatttcctgggctttgactattgtatctatgaatgtgaactatcgaagctctttctccagatctggcttctcttcagactccagtcccatgtcttcatttgctacctggaagcctca

SEQ ID NO: 340699 - DNA, 408 bp, Homo sapiens
gtcactgagctcattatccctaagcagcgttcaaacccaggcagtcaggcaggcaggcaggcaggctggctctggagcctgtgccactgccctctctggtaactgattaggaccaaatatccctgtgatagtccttcataaaggctgtccttgacagctgagcctttgacaaatcttgggcagcagtgagtttaaggaaatgtgtgaatcctgatgagttcctgaggggccaacattctggagggctagttactgtggagccgtatgctttacccgtgggctgagatggaataggaccaacagatttccgctcagggtcccagtatgggctctggcttgaactgaaggtgatccatgagctgggttcagaaaagggggtaggcaaatagggaagcaaggccaaagtgc

SEQ ID NO: 340700 - DNA, 851 bp, Homo sapiens
agttgtcctctttctttcctacacctcaatagcctcaatcattacccatacttaagagtacatactcacttaatttgggcccaaatgtgcaaaggggaccagtccttatttaacactgttacttaatgatggctcctccatgatgtaaaaatgatactacatattcatctttccaacaaactcaacaccagaacggacctatgttgtgaaaaaggaatcagccaaaagcactattcaggaagtatccattggatcaaagtttcactactgagtcaaaaataggaaggtcgactttaagaataagatgttccaaaatatctaagctactttacttctaggatatgctttctagaaatgcagaagaaaaaagttcacatgaaaattttatcagctcctgggatttgcttctaattcattcaacaaatatttgctgaacacctatgggcaagcacaacactaagcacttggaaacaaaggtgacaagataatgtgtggtctcccctcctgccaacccccatagaacttatttaaaagctttccagttttttgtctctcccattcatttgttaacatactatatgtctacaatgtggcaggaatgttaggtacttgggggagcaggtgttgactaagacaagactcttgccctcaaagaactgagagatcagtagaaaagaaaaatacaaataaggatgttaagtgctataaaagccacagagatactgtgggtaaccagtggaaaaaaataactaattctagttatattaatcaggacacacttcctaggagatcaatatttaagtagggtctgaagagacaaatgtttcccagatgaaaagaaaagaatattc

SEQ ID NO: 340701 - DNA, 2762 bp, Homo sapiens
gatctcttgtaggctctctgtgttccaataattttttgactatcataccaggaaaaaaccaacaactctattcattcccaaacaaaatctcttcccccttagtcaatagcttgcgaaagacatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacatttccaggcagtatccctaagatgagatcctggagaaaggactaggggaagtatctttctggatgcttgtggtcccagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatagtcaaaacagccatttttgccaacaatagcttgtggctccccacattttcctaccctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggtcagaaaacttactgctagtacctagaaacacacaaggctgcccagccaaatcttaatgtaaagtagctagagccatggaagtacagtatgaattaaaaagaaaaaagtattgaactacaataaaaaatggtgt

SEQ ID NO: 340702 - DNA, 1335 bp, Homo sapiens
taggccggagccctgccatctgggggaagggagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatagtcaaaacagccatttttgccaacaatagcttgtggctccccacattttcctaccctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggtcagaaaacttactgctagtacctagaaacacacaaggctgcccagccaaatcttaatgtaaagtagctagagccatggaagtacagtatgaattaaaaagaaaaaagtattgaactacaataaaaaatggtgt

SEQ ID NO: 340703 - DNA, 2708 bp, Homo sapiens
gatctcttgtaggctctctgtgttccaataattttttgactatcataccaggaaaaaaccaacaactctattcattcccaaacaaaatctcttcccccttagtcaatagcttgcgaaagacatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacatttccaggcagtatccctaagatgagatcctggagaaaggactaggggaagtatctttctggatgcttgtggtcccagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatacctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggtcagaaaacttactgctagtacctagaaacacacaaggctgcccagccaaatcttaatgtaaagtagctagagccatggaagtacagtatgaattaaaaagaaaaaagtattgaactacaataaaaaatggtgt

SEQ ID NO: 340704 - DNA, 246 bp, Homo sapiens
gagagctggttccagggaggctcaggtcaaaggtgattttattttattttttaatttttaatttttttgagactaggtctagctccttccccaggctggagtgaagtggtgtgatcacagctaaccacagtcttgacctcctgagatctcatggctcattacagcctccacctccctggctcaagcaatcctcccacctcagtctcctgagtagctgggatcacaggcctgcgctaccatgtctag

SEQ ID NO: 340705 - DNA, 171 bp, Homo sapiens
ctacgtccagctaggaacagagattcatttcttacatttctggaggctggaaaatccaaggctgagaggcctgcatctgggcctctggctgtgtctgtcatcccataacaagaggtggaagggcaaaaaagcatgagagagaaagagagagagagagagaaagcaagagag

SEQ ID NO: 340706 - DNA, 663 bp, Homo sapiens
agttctagatttaattacagcagttacaattaattcaagtgaaatattaatctcagagactctatggaaataggtgtgcatttgttagagtatatctatttttcccatgctttaatggataatttgtttttggttagtcattaacaaaaataatcaatcaaagtttaaagaaatgaagtattgtttgatttcagagaaagaaaaatacatgttctacttactgttcttaagtagaacagaaaactctaataagtacagcagataacctaagatacaaatgagttccatattatgtctcattaagaaataataagaggcaggagagaggggcaaaggttaaaaaggagaaagaaatagcttcttgtaacgtttgcttctgtggacacagaagccttcaagccttttcacaatgttaagcataaaaggaattgtcatctcccatctcttgtcctgctgctgaatagaatgaagtgaaagtctggattttgcctgggttgggattctcaactccctggcttcatcttcaatgacatgtttctctccatttctacgcgtctgccgtcccagtacatctatggctttggggaaactgagcacacgactttcagaagaaacatgaactggaacacatggggaatgtttgctcatgatgagccacctgcg

SEQ ID NO: 340707 - DNA, 409 bp, Homo sapiens
tgccgcctctgattctctctctgcaaagatcagcttcctccacctgaaagtgatctatcacacagcaaccatgctgcaggtcaagatctatgaccccactaataaaaggtatgaggttccagtaccactgaacacccctccccaaccagttggtgaccctgaaaaccgtctgtatgatgtcaggattcagaacaatccttttggaatccagattcaacgcaaaaactccagcactgtgatttgggattctcaactccctggcttcatcttcaatgacatgtttctctccatttctacgcgtctgccgtcccagtacatctatggctttggggaaactgagcacacgactttcagaagaaacatgaactggaacacatggggaatgtttgctcatgatgagccacctgcg

SEQ ID NO: 340708 - DNA, 455 bp, Homo sapiens
acactgaaatttaaccagggccgtgaatggttttgtttgtttttgttttactaaatctggcagccctagcctcagtgccccatcccaggttatatcactgactggtgtttcatttccttctttcttttgtttgatttcactgataagacaccattattattgctctatgtcatccctgttcatccaggctttcctgtacttatgtcattttcttggctcatcattccttctcatttctcacactgtcttctaggattattttcatactgccttaagtataatacatccactagagtgtcccttgggaaaacactcatgtggtcaacttccccagctcgcgtttgtgaggaggcaggtctttatctcacccttgttcttggatgatagtttcactggataaacaattctgggttgacaaggatttgctcttgacacattgattggcttaagatttt

SEQ ID NO: 340709 - DNA, 204 bp, Homo sapiens
atgctactttttgtctgcaatgattctacctattgttagttcactgcatcctcagagtcagtgcacaggcaggagagactgagattatttagattctcatagtacagcatataatgaggaagacaggctaggatgccatgggtgccacattagtgccttctttaaggttctgatatacaagcagccctgccccagttggtttgt

SEQ ID NO: 340710 - DNA, 670 bp, Homo sapiens
tcgcccaacactcctgcagttttaaacaatctaggcaatataacagccagctcttctaaagatcactgccttcataagcacattgtaaatcataaattattgtaatttatgaaatgcagtagaacagtgaaactatgtttgccttcccaaacatccatcaggaagaatattggtaattagtttgtattcaatttgtaatttgattgtttaaactggcgctttgttcaacgtttgttttttgttctgttttgttaactaccactttgcaaatattttattctagaatcacagcccatcatgttctaaaacaaattgaattgccaagaaatacacctcggttttagtctgttcaggctgctataacaaaataccacaaactgcatggtggcttataaacaacaaaattcatttctcacagttctggaggccagagagtccaagagcagagaaccagcagattcagtgtctggtgaggacccgtttcctggttcatagatggcgtcttctccctgtgtcctcacatggtggaaggagcaaggcagctatctggggtctcttttataaggcagtagtcccattttcaagggcagagtcctcatgacctaaccaacccccaaaagggcttacctcctaatattattactgggtcggtgttgggggtgggatttca

SEQ ID NO: 340711 - DNA, 919 bp, Homo sapiens
tgtgatgttgtctcatctaactctccacagcctggtcaccagccaggggcagtatccacccacattactgagggaggagccaaaagccaagggagactggtgatgctcggactagagcccaggcatttttaactcctgttccctcaccagcctgcaggaaatggaaaaggcatggatttagggatatgttcttcctaagtcttggagtgtttaatcttggagagagaaagggctttagtaagaagtgtctactgctacccgtttcaggaaccctttttatagcatctctggccactgtttgtcctcttctgggttatgtgctgtccaaggagagtgaggtccttttttcaggaagctcttgcttatattttatactgaatgactcacacctcttgggcttggagccccatcatggcaggtacaaagtagttcctcatccttatttacatgcaagccatcagacttctttttaagttgcactcttgggtttactaagtgctagacactgtattaactacattatctcacttgtcacaacagcccattgaggcaggtatcgattgtgaaggtgaggaaacaggccaggagaggagtgactagcctgaggtgcagagcctgggtgctctgggatggtgttgcttcaggacacgtgctcttggccggatgatcgttcttccagcccccatttcttattctctgaggtaggcctcgcaagcatcttcagccattggcatgtctgttatttctgccttggctgattagcttattcatgggtagatggcagtgacctctcaagtagtagtctttcctcatcttcacatccaccctgtcacaagtccagtaggtgtaaccccaaactaaatgccaaatcctcctttctgtctccactcttgtcatcctaatctaaccagaaccgtct

SEQ ID NO: 340712 - DNA, 593 bp, Homo sapiens
gcgctcggcccgggttactagaagatagagagtgctgcttattgtacctcttctgcccactcatttctgttccacctgccccatcatggcaggtacaaagtagttcctcatccttatttacatgcaagccatcagacttctttttaagttgcactcttgggtttactaagtgctagacactgtattaactacattatctcacttgtcacaacagcccattgaggcaggtatcgattgtgaaggtgaggaaacaggccaggagaggagtgactagcctgaggtgcagagcctgggtgctctgggatggtgttgcttcaggacacgtgctcttggccggatgatcgttcttccagcccccatttcttattctctgaggtaggcctcgcaagcatcttcagccattggcatgtctgttatttctgccttggctgattagcttattcatgggtagatggcagtgacctctcaagtagtagtctttcctcatcttcacatccaccctgtcacaagtccagtaggtgtaaccccaaactaaatgccaaatcctcctttctgtctccactcttgtcatcctaatctaaccagaaccgtct

SEQ ID NO: 340713 - DNA, 520 bp, Homo sapiens
tggaccatgacaataaacaacaggtactggatgcaactgagcacttcccatggcattctggtcctctcagaagtcaaacgtacttatgaaattttaagtacaaaaagaaggtatcttaaatattttttctctaaatcacacacacacacacacacactctctctctctctctctctctctctctctctctctctctccccgtctctctgtctctctctctctctctctctagatactccttctgaccctctttctagagctctctacacaatatacaagcgaaaaaatttcttctttcatatacactttctagagagacacgctgtcaccccatacacaagactcacacacacactctctcttcgtggcactcccttccctccagacatggggtgtctaatcctcactcttttctctccctctatgtgtgtccgtgtgtggggccatgtgcttccctccaaacagagcgtgtgctttcttctaacatacagaggctgagagtgtcgcgtgcatatctccg

SEQ ID NO: 340714 - DNA, 694 bp, Homo sapiens
attttccttccagaaacatgggtattaatgattccctaaagccccaaattaagaacccctgttctaggagtagcctcaacatgctagatttaattgtaagcagctggtttaagaaattatgtaagttgcaatgatgaatattcctcgtcactcacaaatgttattcatcaatttaaaaattaatatgtatcaagtactcagtgtgttccaggcatgattttagttacaaggagtacagcagccaataagatattacagttttcagggagttttatcctactagggaagacagataagtaaataatgaccgaaggctagttaacaagtgctataaagagatataaaaaggaaagagcctaaggagattgaaagtgatggttatgggagagagatgtctatattaatagggtggtcagggaaagcctctctgaggaggtgacagtttgaatgagatctgtatgaagtgtgtgagcaagacctgtgaagatcttgaggaagagcattcaaggtgtagagaacacttgcaaaggccctaagatgggactgagcccggtttgttggattttcatcagtaagcccggggtggcaggagcatgcatgctgatccaggtatagaatgagtggtagaaggtgagatcaggagccctgtaagctgttgtaagcatcgttgttttaatttggtagaaactcagtt

SEQ ID NO: 340715 - DNA, 618 bp, Homo sapiens
gcctcagctagacagggcgggctgcggcgcgcagtcttaggcgtgcgcttcggggaaggggccctcgcgtgggaggagcgcgtctgcgagggatgcgccggcgcaggcgagacccggagccgcgtggtctctgcgcagtgcgtcgtgtggggcggccgaccccggcccgggtttccctgctcgttttcgtccgggcgggcgtcttggttcccgttccaggccagccccatcctaggtcgctgcttcatccagcgcttggggcatttgtgtcgttggcgttgttttcctcttaactacaaactttaaatgtgttcatctactcgtgacggcgagtttagcagactttcattcccagaagacgtgtcacacgatctgtatatttttcatacagaaattgacggacgtcgttacttctaaatttccacaggggctggttcatcccgcggctttacctagagaaaaacgtctgaggccgggcgcggcggctcccgcctgtaatcccaacactttgggaggccgaggcgggcgaatcacgaggtcaggagttcgagaccagactggccaacatggtgaaacctcgtctctactaaaaatacaaaaaaaaaaaaaaaaaaaaaa

SEQ ID NO: 340716 - DNA, 93 bp, Homo sapiens
ccaaaaaaccctcaacactgtatctttgttcttttcccatgtcctctaccctactaaaacgaacaaataatataaaccccaaccactgagtgt

SEQ ID NO: 340717 - DNA, 99 bp, Homo sapiens
tccagcagttatttgaagataaatatgttttgagtgtgagggtatattggggtctggaccaatgctatgtgaccataattgtaggtttggatttgtgaa

SEQ ID NO: 340718 - DNA, 388 bp, Homo sapiens
cttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacac

SEQ ID NO: 340719 - DNA, 992 bp, Homo sapiens
aatacctgaccatcagtttcctcttcccactgagaacactgtatcttcttctaggaagtacttaagtactaaagtactccttaagtactaaaactaaagtcagagactatcatcatagggataggaaaaaaggacataccataccttatgggtcagcatccccaactcatggggtaatatatcccacttagcttggtgaatgattttcagcagtcatcaaacaggcaggaggctgtgtgggtaggccctcctgtaactccactggtcccgtgtgccttactcatactgtatttcttaccacaggttgggatatatcttgctgtaaggcaagtccctacccagttcttctttggctttttttagccaatttcatttctacaaatgtcttagaatcagctagtcaagatacatacatgccatgcattaaatccataggtcagtctaggaaggaaagtcacaacaatattgagtcttctagtccaagaacacatctatcatttcatttatttaaactaacatctctgaataaagttttgtaactttctttatactttccttgttagatctattttatatttttatgctgttgtaaataatatttccttttctaaccatttgttgctggtggagaggaatgcatttggatttttggtgaatgtattctgtatccattgactttgataaacactcttactaattctgaccatttgccatagattatgttggagattctgtgagtacagttataccatctaaaaaaatgacagtttttcttcctttctaattcatagtcctctatttgtgtcttgcattactgtattggcaaggatctccagtgcaaatgttggtagatgtgatgtagggggacatttcttttctccttcacagtctcccacatcaagttctcaatgtttcaccatttagtggttgctctggaattctgtaggtattctagaacagattaaggaagatcccttctattccaggattgc

SEQ ID NO: 340720 - DNA, 423 bp, Homo sapiens
tccacccgcttgggcttcccaaagttccgcgattacaggcatgaaccacgcatttgctttttttaattttaattttttttatttgtcaggcaagtaagacagttaagggacacttgtttttatttctcttgggtatataaagatcgagcatcccaaatccaaaaacttgacatgctcaaatcttaaactttttgaatgcctgcttgatgctctaaggaaatcctcattggagcatttggatttctaattttcggattagggatgttcacatatttgcagatattccaaaatatttcagattcttaaaaaacctgaaatctgaaacacttgcggtcccaagcatttcagataagggatactcagtctgtacctaggagccgaattgctgagtccacatggtaactcttatgtttaattaacttt

SEQ ID NO: 340721 - DNA, 678 bp, Homo sapiens
ctcccctcctcgaactcttacagtccaccatccccactgtcccacactcttcaaattcatcatcatttagcaccaaaggcctggtatgatgaagtgacttctgtgtgtttctgacttcccttcccaactgtgccaggagctccttgagggaaaggaaacctagcttaactttgcctgcatcctggatggagcgaggggcttgcaggtcacatttgctcagaaaatagtaatggtaatggaattattagctgatagcgtgcatcagcaactggtaagcttcatagtacctttcagaagacgtaggaaataagcaaagatctcaggctgcccaccagccttgtgaacccgatcaagaagtcaagcctcatagcaaagggatccacagacgcacattactgccatgggcccaataccagaaatgttctttaagcaatcagctggtcttgagaggtgcaattaaaaacagcaggggaatgacagccacaggtgccagttaggcgaaagcaaccagcggggaagtgcaggaagctaaaatgtttttgaatgaggaagctctgcccacttgccataccagggagagagagtcatctgtggctaaggttgtaggcagacattaaatacagcgatttgcaataaacttgctcaacaaatatttgttaactggagatttttatcaag

SEQ ID NO: 340722 - DNA, 235 bp, Homo sapiens
ggtcagcagatacaggttggggccaataaatatgtatttttttaatttttaaaacttttcaagtagcctcccaagacatagtaggctcagagagactgccagaaatctgtttattcaactacctggctattcttcctcagacagaaagtagatagccaggcttggaaaccaattcagagattttctctctgcatgtatgaaaatctggtctcacgtgactgccacaccacttctt

SEQ ID NO: 340723 - DNA, 782 bp, Homo sapiens
tttggaggtatgctgactgcaacaaaggaggtgggctctcccggaaagaaaacaaccaatcaaccacaaagatttctaacactcatttggagaacctccagagcatccggagaaacctttttaattggtgcaatgacaaaacttggaacctttgaaaaacattcctttggtgtggcttggattcctaggtacacgactggagtggttgttcttgacatgccctgtataaagtgcatagtattttggaggctgcatagatgcaatgacaaaattggatattctgccatatttgcaattcattgtactgcttatatctgaaaagtcacatgagtttggtgatatggtttggctccatgtccccacccaaatctcatgctgaattgtaatccccaatgttaagggagggacctggtgggaggtgatgggatcatgggtgcagatttccccattgctgttcctgtgttagtgagttctcatgagatctagttgtttgaacgtgtgtggcacctccccctttgctctctctctctcttcctgccatgcgaagaaggtgcttgcttccccttcactcttccaccatggttgtacatttcctgaggcctccccagccatgcttcttgaacaccctgtggaactgtgagttatttaaacctcctttcctcataaattacctagtctcgggtagttctttataatagggtgagaatggactattacacttggaaaatagtgtgttatccagagagagaaactcatgttgtaaataaacgaaggaagggctg

SEQ ID NO: 340724 - DNA, 430 bp, Homo sapiens
aaattaccactaaagaacttattcatgtaacaaaacaccacccattgccccaaaacctactgaaataaaaaataaaaaataaaaaaaccttccaaagtggaaataaaatcattaggaggaattggcttggtattaaaattttcagtgactcaattagcatacatttattgatactactatgtactgtgacagaaagtccaggttatgaacgtgggtttgttagaaaagctatttcaacccgaatttcatagaggcacctcaaattctgtatttccaaaactgaactcattcattaccttacctgccatgcttgtgtgagccatcaacatctcacttagatgactgatgcaaaagcctcccaactggtctccctgcctccactctttgcccctacattctgttttaacgtagctacctgagtgatccttta

SEQ ID NO: 340725 - DNA, 246 bp, Homo sapiens
cccaggggtggaatcaatactgaggatgacagagggacagatggaaagtcctccgtgacactcactatcaatcacattgcatctggagctcgccttgtctctggattcctggttacagggacaataactgttcttctggttaaaccagttgaatcagatgtttataaatggcagtcaaaagtatggacatgtctaggaagggctgaaactcttgcagtaacccagccaatcatctgtgatgtcatc

SEQ ID NO: 340726 - DNA, 411 bp, Homo sapiens
ctcctgggttcacaccattctcctgcctcagcctcccaagtagctgggactacaggcggctgccacgatgcatggctcatcttttgtatttttagtagagatgggatttctccacattggtcaggctggtctcgaactcctgaccttaggtgatctgcctacctcagcctcccaaagtgctgggattacaggtgtgagccactgtgcccggcccaagcatcacaatatttctataggtcaatgtagacttggtctgtgctgtgtaagggcttactttcctaagcatttaagtttatacactaaattttttttttttttttttttttgagatggagtctcactttgtcacacagactggagtatagtagtgtgatctcggctcattgcaacctccacctcacaggttcaagc

SEQ ID NO: 340727 - DNA, 405 bp, Homo sapiens
ggacatgtttatcttatgataatgcatcaagctgtacacttaagatctgtgcactttagtgtacgtatgtcagatttcaaagaaatgtttgctttcaaaacatctccacaaacacactctaggaacaaactgagttgtgctcccagtgggatctaaaagattcatccccacagttttaaaaacacgactttcaaggaataagttctagtgttccatcgtacggtaggatgactacagttaacaatcgtttattgtgtatttcaagacagctagaaaagaaaatatggaatgttcccaacacagagaaaggataaatgattgaggtggcggattaccccgattaccctgatttgatcattacacattgtatgcaggtatcaaaacagcccgtgtgtcccagaaata

SEQ ID NO: 340728 - DNA, 163 bp, Homo sapiens
ggcctcccaaagtgctgggattacaggcttgagcgaccgcacctggcccaaactgagtattttttagaggattctttttacctggtgaatagatgggtatgtgctcccccacttcatccacgtacacatatgagctgtacacatagatgttaatcaggttgct

SEQ ID NO: 340729 - DNA, 329 bp, Homo sapiens
gatgtattctggttaaagattcgtctgcgggagcagaggaagggcagggacaggggtctgggagctctactccatttgacattgctgcccgggtgtggcccgcttcggggtcagggggcacccttagaacctgtgcagggcaggaactgccaccatctgttggccacacatttctcagtgaacaaatgacttttggcatcagaaagccataacttcacacctaaacttccacgaggctgagctcttcctgcccctctgtgtgtgtacgtgtgtgtgtgtgtgtattgaggggacgcggctgctggccaccttctgtcggcacaggttgg

SEQ ID NO: 340730 - DNA, 314 bp, Homo sapiens
ctcactacagcctcgacctcccaggcttaagtgatcctctcatcccagcctcccaagaagctggaactacagatgcacaccatcatgcccagctaatttttgtattttttttgtagagatggagtttcgccatgttgcccaagctggtttcaaactcctgagctcaagccatccacctgcctgggcctcccaatctcctcaacttctaaaaagattttgaagtaaacaagaccaaagagtaagaaacatatatagctaagtttacaaataaggagagagagagaaaaaaaagttctattggcaaataaacagta

SEQ ID NO: 340731 - DNA, 478 bp, Homo sapiens
aaccaaaaccacaccgatgattcagcccctgccaggtgagagcagcatctgggtcacaaacaaactgaggccgtgaagactccaccccgactccctctatttaaaaattcctctacaagaaacaggaatggctgtttccttcacctcctagaaggcaacatagtaaactgacaacagatggaaagaaaggcatatttttgtccattaactttccaagggttttggctttgttcagatatttgcatcacaaattccctttgctttctccctggttcctccagagaactctccagtgatcaaggtctccagcaaatgacagcaactctgtatcagtgggatgcacttttgcttttaaagctacgctaggttctcatcaatactccttggatctcaagcctcagcaacagactcagcactgaagacactgggtcgcagcgcccgcagcctggactgaagccctggctttgctccttatcgt

SEQ ID NO: 340732 - DNA, 591 bp, Homo sapiens
aaagggcaaggtcaaatgaggtatcattttttaaatggcatgagttttaaaattatgtaagtttaaacaaatagatcctcataaaaggccataaggaaaattctgagagctatttcacacagtcatgtaattatctgatggaaatgttttacctagagaagagctgggtgaagttgagatttccacatatacttgtcattggaatatacactggttcatgtgtgagaacgtgtggttcttcctccctaattctccagggaaaggatgctactaaaatttccgactacttttctttctttaaacttccttgagattcttttatttttttatttttttttgagagagagtctcactccatcgcccaggctggagtgcaatggcgtgatcgcagctcactgcaagctccatctcccgggttcaagcgattctcctgcctcagcctcccaagtagctggaattacaggcagccgccaccatgcccagctaattttttttttttaagtagagaggggcttgtatggggggcaagttcatctgagaatgtattcatggcataggtgggtggaagtcctggtaagattacttatactg

SEQ ID NO: 340733 - DNA, 220 bp, Homo sapiens
tgcagactctggacttgccaagccaccaccatctcagccagctccttaaaatacacctcccttctgcctctcttctcaccttcaaccccacctctctctctgcatccctccctctctctgtgcatctctctctctgcatccctcccctccctctctctctgcatccctccctctctctgcatccctccctctctctgtgcatctctctctctctgcatcc

SEQ ID NO: 340734 - DNA, 117 bp, Homo sapiens
atgataaggacaggcccgagttgtgaagaaagatgttatgtttggttaaattaaggcagaatatggcatagaaatctttttgtgatatttccattgtaaaagtgtagttttaaaacc

SEQ ID NO: 340735 - DNA, 109 bp, Homo sapiens
ccttcctcagtctaaacaaatgggggaggataacatgcccttccattaacacacccccagtaatcagggagaacagacaaataaacatgaaatgacaattactattatt

SEQ ID NO: 340736 - DNA, 564 bp, Homo sapiens
catgtaagacataactttgctcctcattctccttctgtcatgattgtgaggcctccctagccatgtagaactgtgagtgaattaaacctgtttcctttataaattacccagtcttgggtatgtctttattagcagcatgagagaagactaatacaggtaggttatgttatttgattttttagtattaaaaatcctctcattgcaaggacaaatcttactttgtttgggtgtgtaattctcttggtatcaagataatattaacctcacaaaatgagctgggaagtaaccttctttcacatttcagaagagtttgtggagaattggtattaattcctcttcagatagttgttagaatttaccagtgaagctatctggccctgggttcagattaactttgtgggtagtcttttaaaaactactaatttagtcattttacttgttataggtctactctgattatctgtttcttctcaagtcaatgtttcttctcaaatcaaaaatgtttgtctttttatttaataatttcttgcttatcttagttgttgtgctagtattcatcagtga

SEQ ID NO: 340737 - DNA, 431 bp, Homo sapiens
cccagtgggcagtgactaggaactttgcatggctggagtctaatagggcctgagtctgttcctctgctggttccaaagaggcgttgtttttttgttttgagatggagtctcactctgtcgcccaggctggagtgcagtggctcgatctcggctcactgcaacctccctttcccgagctcagttcaagcaattctcctgcctcagcctcccgagtagctggaattacaggtgtgcgccaccacgcccggctaatttttttttgtatttttagtagagaggtattttgtcaggttgtccaggctggtctccaactcctgacctcaggtgatctgcccgcctcggcctccgtgggattacaggcgtgagccaccgcgcccagccaccaaagaggttttgatttaacccgaggtggggcaggccaacgctagata

SEQ ID NO: 340738 - DNA, 399 bp, Homo sapiens
cctcctgcttttgcaaatacagtttaaaggaacccggacagggcatagtggctctcctctgtaatcccagcactttaggaggctgaggccaggagtttgagatcagcacgggcaacacagcaagacaattaagatttgacgcttacatttttctcctcaagggtggggaaaatagtccctaacctcacgaactgaagcatgcaggggccaccacccaagggcttttgcaaaggttaggttttctgttagggtcttgggaaatctttaagaatgtcaattccttgggaatagcttattttaagggatttggacatggaaaggtctgtttgggatggtttgctcttgtaaagtctttggggatatttgtcatcatggcatctttgatgggcttttctggag

SEQ ID NO: 340739 - DNA, 301 bp, Homo sapiens
agatgaaggtgacgatgaggacagaagtagagagaaaaaagtgagatagatggaataggattgaggaggaggactggcaaaatgatgagtgatggaataggattgaggaaggggactggcaaaatgatgagtgatggaataggactgaggaagaggacgggcaaaatgatgagtgtaggtgatggaaatgtgaggactcattacaatattccctataccctcatacatgtttttaaattcccctgatcgagtgtgtgtgtgtgtgtataaccattgcctaaaaaaatttctcataaaaatc

SEQ ID NO: 340740 - DNA, 238 bp, Homo sapiens
tttctatgtttgccaattctagtaccatatggaactggagtcagtcaatactcgttcttcatttctagcttccttgacttcggattttcaagggtcgttcatattgcagtatggatcagaatttcattccttttttttttttgagatggagtctcactctgtcacccaggctggagtgcagtggcgcgatctcagctcactacaacctctgccttccaggttcaagcagcctcagcct

SEQ ID NO: 340741 - DNA, 223 bp, Homo sapiens
gtcagctagcagaggaagggaagactattctaggcctaatttaggcttaaaattgatatgtatctgaggaaataaaaatctaacagacttttcctcataaacagtagggagccaggagtttaaaaggaaggtattaacaaaacaaggccaaatccaggtttcagaaaaatatctctgtgctatcatggaaaacaaagttttgttacttttttttttttttttt

SEQ ID NO: 340742 - DNA, 1160 bp, Homo sapiens
  misc_feature (2)..(2): n is a, c, g, or t
  misc_feature (5)..(5): n is a, c, g, or t
  misc_feature (1041)..(1041): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtgcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtantcccagctactcggaaggctgaggtgggagaattgcttaaacccaggaggcagaggtcgcatcactgcaatccagcctgggcgacagagtgagactctgtctcaaaacaaaaaaagttt

SEQ ID NO: 340743 - DNA, 1038 bp, Homo sapiens
aaaatatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatg

SEQ ID NO: 340744 - DNA, 503 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagta

SEQ ID NO: 340745 - DNA, 3923 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340746 - DNA, 4137 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaagaaaaaaaatgg

SEQ ID NO: 340747 - DNA, 3828 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340748 - DNA, 2544 bp, Homo sapiens
cagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340749 - DNA, 2252 bp, Homo sapiens
atcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340750 - DNA, 1775 bp, Homo sapiens
aattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340751 - DNA, 1165 bp, Homo sapiens
cctggtaccggtcggagtgttgggatagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340752 - DNA, 2490 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcaatgt

SEQ ID NO: 340753 - DNA, 2534 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340754 - DNA, 2440 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagaccccatgcgccggggatcctacaagagtc

SEQ ID NO: 340755 - DNA, 2664 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccctctgcccccactcaccctaccagtaccttgagttaccgagtcaccaccct

SEQ ID NO: 340756 - DNA, 1600 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctctt

SEQ ID NO: 340757 - DNA, 869 bp, Homo sapiens
atcacatctgggatttggggaagtccctctccaggcagctggaggatctgagtccctggccaacctcagcactgagaagggccgctcagcaaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctcta

SEQ ID NO: 340758 - DNA, 488 bp, Homo sapiens
tctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggc

SEQ ID NO: 340759 - DNA, 521 bp, Homo sapiens
ctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacga

SEQ ID NO: 340760 - DNA, 2821 bp, Homo sapiens
aaaatatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340761 - DNA, 3979 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattggtaaatcccagtcccggaattcaggccgtgtccttcagggagagtgtggtgcccctcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340762 - DNA, 3400 bp, Homo sapiens
atatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340763 - DNA, 1829 bp, Homo sapiens
aggtcatagaggatgcaagccacaggaattcccatagcctttgtgtgtgtgtctgtcttctacctggaaaacaagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340764 - DNA, 1530 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 340765 - DNA, 2439 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggggaaccaaggacccggaagtttcaacgggccccttaaaatgggagacctggtttaccagaaccggaaagaaaa

SEQ ID NO: 340766 - DNA, 2457 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgac

SEQ ID NO: 340767 - DNA, 2140 bp, Homo sapiens
  misc_feature (2)..(2): n is a, c, g, or t
  misc_feature (5)..(5): n is a, c, g, or t
gncanagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatg

SEQ ID NO: 340768 - DNA, 398 bp, Homo sapiens
aagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctt

SEQ ID NO: 340769 - DNA, 539 bp, Homo sapiens
ctgggtattcaagaagaaaaggagaaagagtaggagagagtaaggggaggaggaaagggaagaagagaaggatgtttaattgcctaaaaggaccgttccctccccaattataacagcattttgccatgtacaattccatcataggctctgggtgctttagaagtctatttagattaagaaacaattacgcttagtttggagttttgttcaatatgtttcaaattctgagaccactaggactattccacatgaatggcttatatcaaggacctatttgtagacaaaaaagtaaaaggatttgtgaatatatcaaaatgtctatgagtataaaagcttagaccaagtggagtcatatgaagacctaagaaaaggattttaaaagtctcaaatggggcggggtgtggtggctcatgcctgtagtcccagctacttgtgaggctgaggcaggagagtggcgtgaacctgggaggtggaggttgcagtgagccaatatcatgccaccacactccagcctgagcgacagagagagactccatctc

SEQ ID NO: 340770 - DNA, 389 bp, Homo sapiens
agtgttcctttagaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaa

SEQ ID NO: 340771 - DNA, 370 bp, Homo sapiens
ctgttacctctaggaggtaggaatgtggctaattttaattttcttctttaaacttctgtgtattttctaagttaatattaaatcaacaaacattattgcttttgatgatgtggaaaacaataaagctacggtcattttggaaaggagagaaaacatgtggtaacaacaataatagtagctaacatttactgagcagttactatgtaccttggttttaagtacacttatattttgatctcataacagtacttatgaggtatgtaatactgtccccatattagagatgagaaaacactgaagcttagagagtttaagggacttcccaaggacacacagctagaaagtgacaaaactaggatgtaaactgagg

SEQ ID NO: 340772 - DNA, 478 bp, Homo sapiens
cgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgca

SEQ ID NO: 340773 - DNA, 952 bp, Homo sapiens
cgtcgtaatccaggtaatctcctcaggtcacagcctctttgacatcttatttatttatttttttttgagatggagtctcactctgtcgcccaggcgggagtgcagtggcgcgatctcggctcactgcaacctctgcctcctgggttcaagcaattctcctgcctcagcctcccaagtagctgggaatacaggtgtgcgccaccacgcccggctaatttttgtgtttttagtagagacggggtttcactatgttggccaggctggtctggaactcctgacctcgtgattcgcccgcctcagcctcccaaagtgctgggattacaggcgtgagccactgcgcccggccaacttgtgctaatttcttaaacttgcgtgatcacctggtgtacttgttgaaaaatacagctccctggcgtggcaggatcagaatctgccgaggtggaccgtgggaatctgtcatttttaaacaagtgtcccaggtggttcttatgctgaggcaagtgtgggaaatgtgtgaacccacgctcatccagtcttccttgtgaccggcagtccactgtgcgcaacgctgcagccatacagagggactactcgaagttagaactagcaccttggtcttgttggaataagcagatctgagtagagccagctgcagtcttatggttgtttagcagaagttattcttcttagcagagaatattatacggtcattttccagaactgtaaaaactctatcatttgttttaaaccagatgatgtgcttcatttctgtctttgacgtcttcagtttcttctcccctggctttacctcctttgctatcagtttgtgctttggttttgctgccaaccttataggcttaggtttggcggcaaaggcactagactctggtgccttcttttccttcgttgtcttaagcccttcttttcctctgccctcatgccctcaccactt

SEQ ID NO: 340774 - DNA, 819 bp, Homo sapiens
cgtcgtaatccaggtaatctcctcaggtcacagcctctttgacatcttatttatttatttttttttgagatggagtctcactctgtcgcccaggcgggagtgcagtggcgcgatctcggctcactgcaacctctgcctcctgggttcaagcaattctcctgcctcagcctcccaagtagctgggaatacaggcgtgagccactgcgcccggccaacttgtgctaatttcttaaacttgcgtgatcacctggtgtacttgttgaaaaatacagctccctggcgtggcaggatcagaatctgccgaggtggaccgtgggaatctgtcatttttaaacaagtgtcccaggtggttcttatgctgaggcaagtgtgggaaatgtgtgaacccacgctcatccagtcttccttgtgaccggcagtccactgtgcgcaacgctgcagccatacagagggactactcgaagttagaactagcaccttggtcttgttggaataagcagatctgagtagagccagctgcagtcttatggttgtttagcagaagttattcttcttagcagagaatattatacggtcattttccagaactgtaaaaactctatcatttgttttaaaccagatgatgtgcttcatttctgtctttgacgtcttcagtttcttctcccctggctttacctcctttgctatcagtttgtgctttggttttgctgccaaccttataggcttaggtttggcggcaaaggcactagactctggtgccttcttttccttcgttgtcttaagcccttcttttcctctgccctcatgccctcaccactt

SEQ ID NO: 340775 - DNA, 569 bp, Homo sapiens
tgctgggattacaggcgtgatccctgttttgtcgcgtccggcccgacaaaacagctcttaatccacctaagaaaaaaaggaaataccacatccagtatgtaccacacacatcatccctcacccagatcaggaaacctcacgatgagttatgcccccagtaagtccatccagcctcattctctccttctttctgtgcctttagctagtacattgcctttggaaagatgtccataatccattaatacttttgctagtagagacacaagtcaattgaagtaggtagctgaaactgctggacaactgggtttattctgcaggcttatttcacaaagagcaaacctcagaaaactgaggccattgctggcctggctagttggatttccagatattgaccattcctggactccttgttacaggttttcatacacctgctgagacacatgactgcgcttgttggataatcctgatgtcattgaggaaattaaatgagatgaggatgtaaattgtttagtgtgcagtgggcagtcagtggtgttattatctcatttccacattgcaggtatttatgc

SEQ ID NO: 340776 - DNA, 205 bp, Homo sapiens
gttggctgggtgggtgctgtgaggaggcagcatgggttaatgaaagagcaggacctccctcagagtcggggaggcctgagttccatcagcccctggaaggggtgggattggaccgtgtgaggcaccatctttcagaagagcctctgacctgcctcctcacctctctctaggctgtactgtccaagatgtagccactaaccgcatg

SEQ ID NO: 340777 - DNA, 401 bp, Homo sapiens
caggccaggctctggaaatgcaagataaacacatctctaaggccaactttccaagtcaggaataaaaacaagtaatactttttcaatgtttaccacataccaggtaatcttgtaatatgttatacagaactatttactctgtgcagtaaagatgactattagtcccattttaaaacagaaaagggccaagcgcggtggcacatgcctgtaatagcagcactttggcaggctgaggcgggcagatcacgaggtcaggagttcgagaccagcctgaccaacatagtgaaaccctgtctctactaaaaatacaaaaattagctgggtgtggtgatgcgcgcctgtaatcccagctattcaggaggctgaggaaggagaatcgcttgaatctaggaagcagagtt

SEQ ID NO: 340778 - DNA, 209 bp, Homo sapiens
gtacagagaggttaaataacttgtctgagggtacatagttactgagtggcagggatttgaatccagaatattcttatgtaaccagttctccaaaaactagcccttgaaggtcttccacgtttcaacaaagcaactgaggcttatacatgatgtcttcatgatgtcagaaggaagaactgtgaaaggcaaagcggacccgggaggcagag

SEQ ID NO: 340779 - DNA, 605 bp, Homo sapiens
aacccaccaattccgaacacatcatctcatataatcctcagaaattcccaagaatgatggtgctattgttatctttaccatacaaaaggggaacctgaagatcacagaggtttagggacttgcccaaaatcccacagagcttggattaaaaatcagaccacctgtctcttgagcctgtgttctcagccatgtctgtatgtaatgatgttttactaatttggacaaatgacagtccccaccctaccattatacagcaggagtggagttcatgagttcaattagtttgttgatggcaagtaaagatgctacattatctggttgtatctagatgttttatctcccagaccactgagcagccacagttcccaaaggagtagcaattggtctgggagagagggttaagaagagagaggaaaaattaatttctctttctcctacattgtttctctgagtcccaggacatgattggttaagtgccaacaggagtcatgatgactcacaatgcagctgagaaccctgttaccatttgcaatgacaagaactaaacactagccactaccaccagggttactcctggttcagggctgaatacagtgagtaagtgg

SEQ ID NO: 340780 - DNA, 2709 bp, Homo sapiens
  misc_feature (2)..(3): n is a, c, g, or t
  misc_feature (9)..(11): n is a, c, g, or t
  misc_feature (632)..(632): n is a, c, g, or t
  misc_feature (2210)..(2210): n is a, c, g, or t
  misc_feature (2247)..(2247): n is a, c, g, or t
anntcgccnnngtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtgagttggtttttttcctattgttttaaataagaatttttttctattattgaaaggacagatacatttactataaatcatagtgaatcatgagttttgctttcttcattacantaacctttgtacttaaaatttgcgcatcaggataatccactaaagcaaatcttagccttttattaataaatcattgtcctttataaatgatatcaaggattggtaatgttgatcaagtacaaatagccgaacaggaatgaaaatattgattagcttaccaacatactaatattgcatgtaactaagggctaagtgcatattgtggaaggaaaagagtgtaggcagttatattttgacagtctgggtgaatgtagtagttcacattctgttttataactcaaatgcatatatgacagttgaaaaagaaagtaatttaaagtagtttattgattgccataggagcattggatatagtgatgtttaaaatattttaaagacgaacagttttggccaggtgtcatggctcatgcttgtaatcccggcactttgggagtctgaggcaagaggatcacttgaacccaggagtttgagaccagcgtgggcaatatagggagacctcatttcacctccccacccccttccccccaaaaaacaaaagaaaaaaaacaaatgattcaaaagtaacatagaaaaaccagaataaattagacaatttggactagggaaaaaatgatttcttcttggttagtaactacttaattatcagaacacatcttatacagacctatagtaaaagatgtgtgtatgtcctgcttcattgtgctacatgttgaatttcattaggctttaccagttaatacaatttagtagaatgattttttccctgtaataaacaagccaaaaactattctgaaagtcttattttctttcacgtatgtattaataatatattctctttttaaatcaatgttatatatcctcacattttaaagattcaaataattttcctacgcgtttgctgccaaaaaaaaaaaaaacagatatcacctttcctatttcccattcaccattccttctttataggagcaaaaacttttacctcttttaatggattattttggtatttatatttatgtctttaaataactaacttttaattattaccatattattttccagtttggggcattatcggtttttcagtaatataatctaatatttatactcacattttctcaactatccccaaaatgtcttacgtctttttccctccctgaaaacattgatttgtatgtgttcttttgtcccttttaatctagaacagtcctcctgttctttgtttttttcatggaagagtgcaggtcagttctcttgtagaccagggcattttggatttatctagttgtttcttcatgtttagattcaagttaaaaggttttggcaagagtatagcataagtgatacctcacattgcatgacatcaggaggcttataaagtcatgttgtccttaggttatgctaaatttgatcatttggttaaggggaagtctaccagatgtcttttgaaaaggtatatttttctctttgcaattaataagtaatatgtgggtcctgtttcctaacaggttttcacccagtagttttatcattcttgccttaatccgttattatattggatttacaagatgttgatttaanaaattctattatttcttaaacatttattaactggctnttttatatataaagaagagctttttattccccaccaccaccttttttctttttttccgattatggctgtgaacttacgcatttttaaaataaatatattataatttattattgtcattattcattttgatgcacaaattgtttcaaatttaacaagagaaacttctcaagccaattcctgtgtctttgtctttgagtatttttggtttattgtatcgtaagatgttccaagctctcattgtgccttttttttttttttttgcctcagatctggaagcagccattctccagggtaccctagctccttttagtattaatggtatttagaaactaagatgtatgggttgggagcagtggctcacacctgtaatctcagcactttgggaggctaaggcaggtggatcgcttaagctcaagagtttgagaccagcctggcccgtatggtaaaaccccatctctactg

SEQ ID NO: 340781 - DNA, 1802 bp, Homo sapiens
  misc_feature (1697)..(1697): n is a, c, g, or t
  misc_feature (1747)..(1747): n is a, c, g, or t
  misc_feature (1750)..(1750): n is a, c, g, or t
  misc_feature (1802)..(1802): n is a, c, g, or t
gtgtttgtcgaggaggtttatgtagttttaatatgtgccgtagggcaccgagttctgagcaggtgcgtgtgatgtttgtttattctgagtagagggtcatatggcggttcgttgtggtcatagccgtgtaagcgagtacggcaaaatgttacagttaggattgttcagtggcaggaaactagagtcaaggaatccactcgtctattaggggatggaaatggatgctgataagggatcaggcaaatgtatgctttggatgaaggtcccaatgtgttccaaaagttgcatgcaagtggtatgacgctgggtttagctaaataccgttgggatcaccattgtaaaaatggtgatcgttctatccaccaagaacccgacaatttgagtgaaagtagtctgtcgtactaggccatcaacctgttgtcatgcatacttcgactggggttgcaattagccagtcttgtcttgttgtcttgtctgttgttgttcgataataggttttcaaagtgtttcctcgtcacccaattgatcagaagttgaatgtgcaaacactcgattataagcaggggagaaaatcaacagagatcctgaacagttaagatctgcttcttcattctcatcctcttcttcaagtgaatgttttcaatacagttgtcattcctttgcctctggaattctatcacgatgttatatacatattgtttcccaaatttcattttattttgtttcaagcagagaaacactgaaggttttctgatgctgtgcctgtttcattgctgtttcacctattttgtcagaatgtttgtcgaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttattgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcaagtctttccccccaaaaaaanggaaaaatttcccccaatgggtcctcaaggttccaagtggcccctccaanaantttttacccaattttcaaaagggtttttaaaaaaagggaaaatttttaaaan

SEQ ID NO: 340782 - DNA, 1068 bp, Homo sapiens
gtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatggggagctgttcagcagtttaacttagatgtcatacagtgtgaattgtttgccagctctgagcctgtgccaggattcagggggatacctggcagcttgcattcattgacctcagacattccttgaactgtttatgggttcgggagtggcctacttaactagctgatattgggcagcagcttctaagtacctcggtgatccaacacaggactttcccctttggagagatgaggttctagcaaagacaaatattgctcggtcaggagaatgatggacaacgagttgttagcgggggacaacgcggcacttggatgttttccacatgtgcaccctggtgcccggaccaacacgtcatgtggttgcacattgtggtccgttgggaaccaaccgagaaccggccccaacactcctcggtcgccacccttgtcaacacccg

SEQ ID NO: 340783 - DNA, 181 bp, Homo sapiens
agaggaaaggaatgaaactgtattgaaacattcacttgaagaagaggatgagaatgaagaagaggtgataggtgtctttctttcttttctattattagataattttttttcttttggattgtaatgtacatctgtgtgatttagtcttcctgtatgcaaaataaatttatgttgtaaaagt

SEQ ID NO: 340784 - DNA, 1604 bp, Homo sapiens
  misc_feature (2)..(3): n is a, c, g, or t
  misc_feature (9)..(11): n is a, c, g, or t
  misc_feature (1499)..(1499): n is a, c, g, or t
  misc_feature (1549)..(1549): n is a, c, g, or t
  misc_feature (1552)..(1552): n is a, c, g, or t
  misc_feature (1604)..(1604): n is a, c, g, or t
anntcgccnnngtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttattgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcaagtctttccccccaaaaaaanggaaaaatttcccccaatgggtcctcaaggttccaagtggcccctccaanaantttttacccaattttcaaaagggtttttaaaaaaagggaaaatttttaaaan

SEQ ID NO: 340785 - DNA, 2655 bp, Homo sapiens
  misc_feature (2)..(3): n is a, c, g, or t
  misc_feature (9)..(11): n is a, c, g, or t
  misc_feature (632)..(632): n is a, c, g, or t
  misc_feature (2156)..(2156): n is a, c, g, or t
  misc_feature (2193)..(2193): n is a, c, g, or t
anntcgccnnngtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtgagttggtttttttcctattgttttaaataagaatttttttctattattgaaaggacagatacatttactataaatcatagtgaatcatgagttttgctttcttcattacantaacctttgtacttaaaatttgcgcatcaggataatccactaaagcaaatcttagccttttattaataaatcattgtcctttataaatgatatcaaggattggtaatgttgatcaagtacaaatagccgaacaggaatgaaaatattgattagcttaccaacatactaatattgcatgtaactaagggctaagtgcatattgtggaaggaaaagagtgtaggcagttatattttgacagtctgggtgaatgtagtagttcacattctgttttataactcaaatgcatatatgacagttgaaaaagaaagtaatttaaagtagtttattgattgccataggagcattggatatagtgatgtttaaaatattttaaagacgaacagttttggccaggtgtcatggctcatgcttgtaatcccggcactttgggagtctgaggcaagaggatcacttgaacccaggagtttgagaccagcgtgggcaatatagggagacctcatttcacctccccacccccttccccccaaaaaacaaaagaaaaaaaacaaatgattcaaaagtaacatagaaaaaccagaataaattagacaatttggactagggaaaaaatgatttcttcttggttagtaactacttaattatcagaacacatcttatacagacctatagtaaaagatgtgtgtatgtcctgcttcattgtgctacatgttgaatttcattaggctttaccagttaatacaatttagtagaatgattttttccctgtaataaacaagccaaaaactattctgaaagtcttattttctttcacgtatgtattaataatatattctctttttaaatcaatgttatatatcctcacattttaaagattcaaataattttcctacgcgtttgctgccaaaaaaaaaaaaaacagatatcacctttcctatttcccattcaccattccttctttataggagcaaaaacttttacctcttttaatggattattttggtatttatatttatgtctttaaataactaacttttaattattaccatattattttccagtttggggcattatcggtttttcagtaatataatctaatatttatactcacattttctcaactatccccaaaatgtcttacgtctttttccctccctgaaaacattgatttgtatgtgttcttttgtcccttttaatctagaacagtcctcctgttctttgtttttttcatggaagagtgcaggtcagttctcttgtagaccagggcattttggatttatctagttgtttcttcatgtttagattcaagttagaggcttataaagtcatgttgtccttaggttatgctaaatttgatcatttggttaaggggaagtctaccagatgtcttttgaaaaggtatatttttctctttgcaattaataagtaatatgtgggtcctgtttcctaacaggttttcacccagtagttttatcattcttgccttaatccgttattatattggatttacaagatgttgatttaanaaattctattatttcttaaacatttattaactggctnttttatatataaagaagagctttttattccccaccaccaccttttttctttttttccgattatggctgtgaacttacgcatttttaaaataaatatattataatttattattgtcattattcattttgatgcacaaattgtttcaaatttaacaagagaaacttctcaagccaattcctgtgtctttgtctttgagtatttttggtttattgtatcgtaagatgttccaagctctcattgtgccttttttttttttttttgcctcagatctggaagcagccattctccagggtaccctagctccttttagtattaatggtatttagaaactaagatgtatgggttgggagcagtggctcacacctgtaatctcagcactttgggaggctaaggcaggtggatcgcttaagctcaagagtttgagaccagcctggcccgtatggtaaaaccccatctctactg

SEQ ID NO: 340786 - DNA, 243 bp, Homo sapiens
gttctggaaaatcctgttcgtttcagtttctaatagtttactgttgttgctaacaacgtttaagtcaaataagggcagggacctttatccattgtttaccaatttgtgctcactacctaatacagttcctggcacactgtggatgcttaatagttggtattatcagtgaaagaggaaagcactgtataatctagctatagaagagaattcccaatatgttacaaaggcagaacaccgtcgaag

SEQ ID NO: 340787 - DNA, 866 bp, Homo sapiens
ccaggaagtttgtcctcttctctttttcgccatctcgaggtgtctaatcctaaaactatcagcgccatgaattttatttaaaactacgcccagtgaaccgggctctccggatttttcttctgaaaaacactgatgtctttggagaaaagatcatttttgcaagttaaagcagatggtttccttccccttcgctttcccccctctcccactctctttaatagtttagaaaaacattttggccctgtaacttctgattggtatgaatagaagcagttctgtgttgcagtaaggggaaatcacatttttacggggtagaaagttgacactaaatgaagattgtgattttagtattttaaaattaattccgtctaattggatttggttttgcaggcagcatctcatatatgtcgagtacttaacaatttaaagctctgacttgtaaatttatttttcagctctcttttttcgtaattagaatactgtttggacttgctcaacaagaccttatcttaacaaaaagtaacttatagaaaagggagacattcatttaacttcaagcccatattattcttaaaagctgactcttgaaatagtatttatggagtcatagtggagtcatgggactttttaagggccggaagggactatttagatcatccagtcccacctgtcattttatgggggaggaactgagggctagataagataacagttagtgggtccactgacctttaggacagtagtctatccgtaagagacaacatggagaaagaaatacaacgtttttatagtgaattatcatcttacaaagaatattcttcccatatcgcacttttaaaaagtgggtaccttagtcaaataggaga

SEQ ID NO: 340788 - DNA, 506 bp, Homo sapiens
ctcctatggctctgggagcaaaggcacaacaggcagggaagaccccatcgtctccctccctgggatggctgaggagcaaactgcacaacagcgggaggggcctgaagcctgtgttcatcgtgggaaggtggaagatgggaagtgcagagccagtctctccagccaatcccagagctcgctgaacttttcccagcactgggtctactgctggcagccttgctgccaggagcaaccccaagggcctcattaatctaagggtagaaaaacaatcccaggatcccaaggagagagggcaggtggagaggtgcatagagcctgggggaagagtcagtctgcagcaagcatttattgagtgcctactagatgctgagccatgccctgggatataaaaatgagtgaggtagactcaagcgctctccaggctaatgggggagtaaaatccatacataacatttgtgagaagcatggaaaagggagctaagacaagggaccccagcttggcgtgt

SEQ ID NO: 340789 - DNA, 192 bp, Homo sapiens
tcaggaggtaaagggcaatcagaaaaagacaaggagaccattggaaaggagataattggaagaatgacttgtgtggcctgctgggttcaatttcagtcacagagaatgccatcagactaaaacaaatcatgattgaaagcactagtagcaagcttatctcttaatgtttgtgtaagcatctcctccttgcca

SEQ ID NO: 340790 - DNA, 1802 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatg

SEQ ID NO: 340791 - DNA, 1444 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaagagagtcttgctctgtcaccccagccggaatacagtgacacaatcatagctcactgcagcctggaactcctagagtcaagcagtcctcatgcctcagtctcctgagtagctggtactacaggcatgtgccaccatgcgtacctagttatttttcatttgtcgtggagacagagtcttgctgtgttgcccaggctggtgtcgaacttctggcctcaagtgatcttcctgcctcagccttccaaattgctgggattacaggtgcaagtggcatgaagaaaatgatattctcttctgtgctttagctgtttgcaagaagattgcatactgcagccggtattctctgccacacaaataag

SEQ ID NO: 340792 - DNA, 1912 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaaatagt

SEQ ID NO: 340793 - DNA, 2169 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaagagagtcttgctctgtcaccccagccggaatacagtgacacaatcatagctcactgcagcctggaactcctagagtcaagcagtcctcatgcctcagtctcctgagtagctggtactacaggcatgtgccaccatgcgtacctagttatttttcatttgtcgtggagacagagtcttgctgtgttgcccaggctggtgtcgaacttctggcctcaagtgatcttcctgcctcagccttccaaattgctgggattacaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaaatagt

SEQ ID NO: 340794 - DNA, 1819 bp, Homo sapiens
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaaatagt

SEQ ID NO: 340795 - DNA, 553 bp, Homo sapiens
ctgcagcaagttatccagaagttctagctgagatcaatgatgaaggtggttacactaaataacaaattttcagtgtaaatgaaacagccttctattggaagaagatactgtgtaggacattcattgctagagagaagtcaatgcctgggttcaaagcttctaaggacaggatgcctctcttcttatgggctagtgcagatgatgactttaagtcgaagccagtgcttaccattcagaaaatcctaaggcccttaagaattatgtttactatctattctgcttgtaccctgtaaatggaacaacaaagcctggatgacagcccatctttttacagcatggtttactgatttttttttttagttttatttttcttattttaaaaattgtgtatatttaaggcatatgtcacagttttgttttttttttttttaacatatgagtgagaacaactgtccctcacctattttgggagaagagggtagatgaagaagaagtgggttaaagggtacaaacatacagcgagctaaaaggaatgaattcagtgtttgatagc

SEQ ID NO: 340796 - DNA, 414 bp, Homo sapiens
aactgtactcagccatccggagacacttcagccccatccccttcctaaaaaaacaagtatcagttgaactttcatacatggaatggatgtttcaaacacccttttatcacctcccactggagattacatttgcaagcagcaaaagacccctgtgtaatgaaatgaaccccctaactggcttttggtgtagcttgagatttccaatttccatgcattggctataacaggcctggctacctgctgagggttgcccaaggtgtatgaacctgtaagggtgatccccggtggaactaaggttagggaagtcctagatgggggatttcctaggaagctgtgagccgagagagagaacgggagctggaacgggagagaacctgaggaccctgaggccaagcctgcttctcactgctgtcc

SEQ ID NO: 340797 - DNA, 347 bp, Homo sapiens
aggtccgatgattctctgcagcggaaagcgcactgggaggggacagaggaagggccaagggcaggtggccatgcagccgacttggcttggtgcagggaggccagagacctctgctcttccctgagcttaggggaggcctccagtccggcacgaatgactgcagtgttttcacaggggcaattctgtacagtcgcagccggatgtcgctgaatgtcctattttagggggtccacgccagctctgatagcatcgcttctcagttactcttttggaagttggccttttccttgcgagaacacctgattcctggcaaagggttccgtttttaggacaggtcgtgagagtgc

SEQ ID NO: 340798 - DNA, 559 bp, Homo sapiens
gtgggtggatcacttgagcccaggagttcaagactagcccgggcaacatgacagaaccccatcgctacaaaaaatacaaaaatttagctgggcatggtggcagacgcctgtgttcccagctactcaggaggctgagatgggaggaacacctgagcccaggaggtagaggctatagtgagaagtgatcgtgccactgcactctagtctaggtgacacaacaagatcctgtctcaaaaaaaaaatttgaaaggcgggggggaacactgatagaaaaaaagattttgtcaaaaaacatgaaattctgctttgtggttttaaagtattttcactataatcgccatttatttttattataggccttagataaggggaaaagtcttttaagagttattcctggccaagcatggtggctcatgcctgtaatcccagcactttgggaggccaaggcgtgtggatcacctgaggtcaggagttcgagaccatcctggccaacatggtgaaaccccgtctctactaaaaatacaaaagttagccaggcgtggtggcacatgtctgtaat

SEQ ID NO: 340799 - DNA, 539 bp, Homo sapiens
ctcgcgaacgtgttatccctcgcgaacgtgttatccctcgcgaacgtgttatccctcgcgaacgtgttatccctcgcgaacgtgttatccctcgcgaacgtgtatatccccattgctaagcaatgcatgactaaatttttataacttcctaagaggttatcccctcttcgccactcccactcctttcagccctacatcatttctcatcttagccaccacagtatccttctaactcatctccctgtccagatttgaaaacattcctgaacacaccccacactactgccagtgatcatctaaaagcatccctttctgaaaacacttataatgaaatccaaatcccatggcataccatataaagttctattcctggcctacatttccaacctaatttagagaactatttgtagttccccaaactcatcatactacttccaatgtccatgcttttgcttggaaagcctttccctgtttttcacctagtcaaaaggtgactttacttctttaaagactcaactcatataccaggtactctgagc

SEQ ID NO: 340800 - DNA, 529 bp, Homo sapiens
tgaactatgtggaattgacttttttcacttttttttttccatagaactctttcaacctatgggaggtagggacttctgccctccaagttttcatcgtgattccaaatgcactactgaagtggcattgctttctttgctattaaacatgggttttctgcttcttctagagagttcttttcctaatggaggtcagcaaactgcaaggcctagcaatgattgatcccagtcccatacagcattttacaaagccaaagtaacagcagcctgagccatggcacagtaaaagtggttttacatttccaatgcctgtcctaaagtagttttagaggtcagcattgatcaataaatcattctgatcacatgtatcctctctgggggcccattagctagtggtgatgacttagtcatctcaccatcagcttcattagtccagaagtcgctgggaccacaagttcaaatccctgttgagctgatgtagctcttggtcttcctgaagtagataaattgagcttcacatagtttgtcgtgc

SEQ ID NO: 340801 - DNA, 178 bp, Homo sapiens
attagggtgctgctaggttttcctgcagaaggagtaagtacagcatttcctcctgtggggctgggagaataccatttgtgttagactcactattatgtatgtgtactttttggtcgtgataatttctaacatttcttaaacacttactgtgtggaggtagtatgctaagtctttattt

SEQ ID NO: 340802 - DNA, 485 bp, Homo sapiens
cgccaaaatccagaagttcaagaccagcttggacaacaaagtgagaccctgtgtctacaaaaaatttttttaattaaccaggtgtggtggagcacacctgtgtagtcccagctacttgggaggctgagaagggagcgtcacttgagcccaggagtttgaggctgcagggagctatcttggtgccactacactctagcctgggtgatagagcaagaccctgtctctgaaaaacaacaaaaataaaaataaatttaaaagaatagtgcagtgagcacccacataacctagagattcaccaattgttaacatcttgccatgttcgtttacatgctctctctttctccatgtatctattttttttatgcacacacttttttttgttgccaactttggaaagtaagttgcagacaaaataaatacttcatctctaaatacttcggtatgtatgttggaaaaaaatttaagttttatttttcctttgctct

SEQ ID NO: 340803 - DNA, 215 bp, Homo sapiens
caacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaaga

SEQ ID NO: 340804 - DNA, 723 bp, Homo sapiens
atgaagagatcagggctagagccagatggcctgaattcaaatcctgctttctcctctctagctgtgtagtagctgtgggcaagttacttaaactctttgagcctctgatttctcacctgtccagggcgggtatgaacaggcccacctcacagtgttgcaaggattcagtgagttcgcatgaagtgattagaagtgattggggctgggtgcggtggctcacgcctgtaatcccagaactttgggaggctgaggcaggcagatcacttgaggccgggagttcgagaccagcctgaccaacatggagaaaccctgtctctactaaaaatgcaaaattagccggacgtggtagcacatgcctgtaatcccagctactcgggaggctgaggcaggagaatcgcttgaacctgggaagcggaggttgcagtgagccgagattgcgccattgcactccagcctgggcaacaagagcaaaaaaaaagaagtgattgggctgactgagtccacgccacatgaagggattagaagcgatgcatagtgaatgtgcagaaagtcctctcttaaggattagggtcaagaagaaaaagaaaggaaagggaaagtgctcaccatttgagacctgtctggaaattgctgtacttagtgtaaatttcttctcagcttcaacatctttgatcgtgattttatcaggaaaatactaataaagccactgttttgttcaacttc

SEQ ID NO: 340805 - DNA, 2212 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340806 - DNA, 2486 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggtgggaactttgcgcgctgcagcctcgccgggcgccaccgaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340807 - DNA, 2390 bp, Homo sapiens
ctgctgccgagacaggatcactttccacacaggaaactcacgtgggggcagggcgtgaaggaaataaatcactaattgggggagttttctgctggagggaaagctgggagggttgaaagaagaaattcctaaaaagaagaggtgattacagccatggggattcacaagagccctccagggcttgtgtgaggcattttccgtttacctccatcaccattcttgccaaacagaatgtcactttttctcttttctgtggtagcaaagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340808 - DNA, 2219 bp, Homo sapiens
  misc_feature (1988)..(1988): n is a, c, g, or t
  misc_feature (2105)..(2106): n is a, c, g, or t
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggtgggaactttgcgcgctgcagcctcgccgggcgccaccgaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcaggtaagagcccacgccccgcggggaaacgcgccaccacgagggaagggactctgagcattgtcacctcctccagaaagcctcctctgattgcacactggctgaatagcatccctggtccctcctgacatcaggaatgtttgtgtgcatggtctgcctccctgttaatatgtgagcatcatgggggtccacgcctgtgcctgtcctggcctccactgtgcccaccactgccctcccccttgccagtgtttagaacagtgtccagcacaaacaggcactcaaccactatttgttgaatgaacaaatgagtgaataaatgggtggtgtgatttttgacgtgcctggccctgagcgaagcacattacatatatcatcaaatttatctcaaccattcggtcctttctcaacgttcctaatcctttgcatcatagtagcccagacacattttctgggtcctgaagataatttttattgataggtacatgtgtgtctacaaatggtgagcatttctttttgttacataagagaatgaatggaaagtttatttactccagggcctgacacggggtgtgtgctacagtctaagggctcccactcatctgggagttcacgggagccggagctgggctgcatgtgccaactacgtcttatctcccnagggaatgctccagcaaccctgtgggggaagtgttttcacacccactaggtatttgaggacactgcccaaccccaggtctaagtccagtctgtctttgtaagcatggaaatatggtnnccacgtggcagcttggggacctaatatagccccacaggactatgtgattggcccacacaaggtttcccaaaaatttgacttggttgccaacaataaaagtgaagttttttcat

SEQ ID NO: 340809 - DNA, 1186 bp, Homo sapiens
gctgctgcgccgcgctcccggcgcactcggagcccggcggggaccgggaggcagagacggggcggccgtggctccgagggcgggagctgagccgggccccgggaccgaagtttggcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340810 - DNA, 1837 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcaggtaagagcccacgccccgcggggaaacgcgccaccacgagggaagggactctgagcattgtcacctcctccagaaagcctcctctgattgcacactggctgaatagcatccctggtccctcctgacatcaggaatgtttgtgtgcatggtctgcctccctgttaatatgtgagcatcatgggggtccacgcctgtgcctgtcctggcctccactgtgcccaccactgccctcccccttgccagtgtttagaacagtgtccagcacaaacaggcactcaaccactatttgttgaatgaacaaatgagtgaataaatgggtggtgtgatttttgacgtgcctggccctgagcgaagcacattacatatatcatcaaatttatctcaaccattcggtcctttctcaacgttcctaatcctttgcatcatagtagcccagacacattttctgggtcctgaagataatttttattgataggtacatgtgtgtctacaaatggtgagcatttctttttgttacaagagcaaaaaaaaagaagtgattgggctgactgagtccacgccacatgaagggattagaagcgatgcatagtgaatgtgcagaaagtcctctcttaaggattagggtcaagaagaaaaagaaaggaaagggaaagtgctcaccatttgagacctgtctggaaattgctgtacttagtgtaaatttcttctcagcttcaacatctttgatcgtgattttatcaggaaaatactaataaagccactgttttgttcaacttc

SEQ ID NO: 340811 - DNA, 965 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtatgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340812 - DNA, 2386 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340813 - DNA, 2270 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340814 - DNA, 2137 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340815 - DNA, 1181 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggtgggaactttgcgcgctgcagcctcgccgggcgccaccgaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtatgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcat

SEQ ID NO: 340816 - DNA, 579 bp, Homo sapiens
gcaaatttaatgatggtccttgccctatatttgtctgctgttcctgcccctacccaaatgtcattttattttatccttttaaaaacatcagttaccctgaccagaaggaaagaatttagtatgttggtataatggtgggactgtaggccgcagactgtaggaatagtgtgctgcaggtgagcaagtgaaacttcattcttagattaataatttatgatagctattagtgggagatagattgcttatatggaacagactcaagattattgtttagtctatgcagaggaagcaaaatgtataaaattgtggaggaaagaacaacagcaagtcattcaggatgtctagagcaaatactcaggatggaggttggagatgcgtttgagagagagggagagcatgataatgtgtgccaggctatagaatttggtgtttaacctgatggagaaagggagtaatagattccaagtggaataaattattttagttcccaaaatggaaatagtgatttttttttctgattgtaaagggaatacatgtttgtcataacatgcaaacaagtaataaaaaaataggcagtga

SEQ ID NO: 340817 - DNA, 1131 bp, Homo sapiens
agatgatcccttgacattgtaattataacaaaactttcagaactcaagtctaaatatgtagtattttctatctgatttgcaccattgactttattaaaattgctatacaggagatggcagtttgatacccaaagctgttcactgatatatggaattttaataaagttcagctttaattttttgaattgttcatacagcaaatatttactgagtacatttttgtctccagtcctccttgacaatattatttactttgtattgagtacttattgtgtgcagacactgtgaatataaagtagacatggtcttttccctctagagcttaccagatgagtgtgagataaatagaaaagtaaacatgccattgcagtacaggtgataagaattatgataaagtacagtgttattattgataaagtacaggttattgaattatgataaagtacaaaaggttataggaaagggatatgtatgtgttcaacaccattttaattgcttcaagagatacaaaagaaatataaagcacctgacttttgcttcagtttgagagactacatggaggtgggatattaaaaaacacaagtaaccgtaaaattatgtgttatggaatatagttataagcatgtggaaaaattggagaggctttgagattagaaaacctggtatcaaatcctggctcagaaacccagctcagaataccacttgccagttagctgattttgggcagttgattaacccaaaccgtttccctcatctgtaaaagggggttgccatccatgcttctcagattatttaaagattgaagggagcatcaaggtaaggatagcaaattcctgtgatggatctgccatcactttctacccaacctcactaaagtgacagtaaaggaattttttaaaagaaactcccattgaaaatataaagggttcgtattaataactgatagggaggggtgggtccctgtacttgattatagtaacaatttggaaactagagaagggatgggtgaaggtaactgatttaatagattcagagaagtttaatcttaagctcgcaacccagtttattgcaagaatcccccaaaaggctcaggaataggcacaggtacttgcagaacttcaggtagggcta

SEQ ID NO: 340818 - DNA, 571 bp, Homo sapiens
tctgtaaaagggggttgccatccatgcttctcagattatttaaagattgaagggagcatcaaggtaaggatagcaaattcctgtgatggatctgccatcactttctacccaacctcactaaagtgacagtaaaggaattttttaaaagaaactcccattgaaaatataaagggttcgtattaataactgatagggaggggtgggtccctgtacttgattatagtaacaatttggaaactagagaagggatgggtgaaggtaactgatttaatagattcagagaagtttaatcttaagctcgcaacccagtttattgcaagaatcccccaaaaggctcaggaataggcacaggtacttgcagaacttcaggtagggctaaaaaaaactttcagttgaaaatctgttgaagaaacaaaagccccagatcccctactccactgtgggtaactgggcaaacactccttccctaccagaagaggagagtagagatttcttcattagaaagagtaaaatagaagatttccaagaataattggggcaggtctttgtacctgaaggaaggggtaaactg

SEQ ID NO: 340819 - DNA, 217 bp, Homo sapiens
tttttttggtgacatcattcaggcccgtggctttaaatattaatatcatctacacactgatgagtttatatttccagtttggacttgtcttctaaactctagacattgtatacaacttcttactccatactagttggcatcttcaacataacaggtccaaattcaaacttccgcacactccttcccacctcaaaaccactcttcccacagccagccc

SEQ ID NO: 340820 - DNA, 531 bp, Homo sapiens
gatagaagcctccataatactcgctgtgttctcagaggacgcctccatctggcatcatggtgcagttgtgaccagggcacaatgacctcacttgcattccattgtgtgcactctaagaggaggaggcagcactgccaactgtggtgcagactcatctgctggtccctcagcccgtctcagccccacgtgcccctcctatacgggattctggtgtaccaggtatgtgtttctggtacagtgtaatcctgagtacaagctatctacttcatctggtgctcgtccaaataaacaacaatctgtttaaatggcagaacaacggctgtgccatcaagagacagcatgtctgcagatggcatttaagccatctgagggatgttcaagggtaacctgacacaaaggcttctgcctcaagtgctgactttatcacttacctgtgtaaggagcacctgtgtttctctgctgtgttgcacagctttgaacagtatgtagctatgtgctcagtttcaaccggagttttgttctcattgcttg

SEQ ID NO: 340821 - DNA, 536 bp, Homo sapiens
ttcccacaggtactttcccacagggcattcaaataaaatttaagtttagcttaatagtatgtaccaatgttaatttcttggttttgatcactgtaccatggttatgtaagatattaacatcagagaaaactatgggaagggtacatgagaactcccagcactgtctctacaacttttatgtaagagaaaaatggctgggcacggtggctcacgctttcatttcttattcactctggtgagaagcgatactgctacaaaccttggtaaacaatttgctaccttttgtagccaaattccagagtgggaagaatctggctataaaatggtccaactactgagaaacagcagtttctaccaaggcctacctactttgtagaaacgagaaggaaaccatctcaggggatgccacacacatctttcttctcatcaagcacaagtacctggcttggaggagcaaagtaaagcttctgaatcagaaggtcccaatcagccactcaccagccctctgggctaaaatggagaggacacttgccccc

SEQ ID NO: 340822 - DNA, 467 bp, Homo sapiens
gcattggaagttgtggatatggaagtttatttacaagaggtttgactaggcaagtattgaaatacaggaccgatactttacaaatttgtctgtagaagtgtagtcattgattcctttgtgctcttgtacatagtcctatctgtactgaacacatcataccatcactcatctgcttagacaacagtctcagtattgtttgagaacagtctacatattggaggtatattgatgcctgtgtatcctcagagttcaacctaggcctagagccattgaaaagttattaccaagtgaaggaacagacaaataaaaaaagcttgatgcatatttactgcttggagacaaagggaggtttacatacaggcctttgataccacaaatgacattacattatgttaagcatcagtttatcatcaccactttgctctaatcttccctcaggtatcttagctcatacaaaagaacaaatg

SEQ ID NO: 340823 - DNA, 571 bp, Homo sapiens
gcggcactttcccatggcccacatgctgcctaagaccctgaaggctgactcctgggcactgtccccagccacccgcctctctgcaactatctgccacccctccacctgccctgggacacctgcctccagatgaaggggtctgctatttcccctgcctcccccagcagaccccagcttccactccgattcaccctggaactgccggtgctggcccaggccaggcttcgggaaccgtgtgagggagagtttgagaaaagcccattctggtgcagaagtagcactcagtgacctctggtgaaccctcagagactcccaggagcctggacgtgttcccagcccagcatgactagtggcatgagtaagtgtggatacctggtggatacctggcttgggtgccaacgcctggaaaggggctggcaggtccatccctgagggctgaggccacgaccacctgctagccctgggacacagagtattaacacatcactcacaccgagcctcagtctccccctctgtaaggtgggctctagcgtcaacctcctagctatgaagactaaatgagatgcctcct

SEQ ID NO: 340824 - DNA, 192 bp, Homo sapiens
gggagagaacagtagaggcagagtaaagggatgacggggaaagttacggagctcggccgggccgagtggttagtgatggcaggtgggagtgtagcggagtggggcgtatctggggacagctgtgatgttaaagtgatgggatggcacaggtccgctgtaatagaaaggtgaggggtgcagagtaactggctc

SEQ ID NO: 340825 - DNA, 456 bp, Homo sapiens
tctgcatataagcagcatataagtccaaatgcctgcagagagtcctgtgggactcagaaaagcacagggactagagcaagcttgttcaacctgaggcctgtgggccacatgtggcccaggacagctttcaatgtggtccaacacaaattcataaactttcttaaaacattacaaggttgggcgcagtggctcacacctgtcatccctgcactttgggaggccaaggcgggcggatcacaagaggtcaggagtttgagaccagcctggccaacatggtaaaaacccgtctctactaaaaatacaaaaattagccgggcgtggtggcacacacctgtggtcccagctactcaggaggctgaagcacaagaatcgcttgaacctgggtggtggaggttacagtaagtcgagattgtgccgctgcactccagcctgggcgacacagtgagactctgtctc

SEQ ID NO: 340826 - DNA, 374 bp, Homo sapiens
tcatgagttcactctcttacttccaatcagtgaaattaccttcccgtgaagaggcgggaataaaaaaataagacgagaaagacctatgagctttaattaatattcaaaattaaaaaaattcaaccacaaagggataaacataacttaacatggactagcaatttcggttggggtgacctcggagtacaaaaaaccctccgagtgattttaatctagacaaaccagtcaaaataaccataacatcacttattgatttgaccaaaattttgatcaacggaacaagttaccctagggataacagcgcaatcctattctagagttcctatcgacaatagggtttacgacctcgatgttggatcaggacatccaaatgg

SEQ ID NO: 340827 - DNA, 89 bp, Homo sapiens
tgggccagaaacaagaccattggatttttacctcgtacttttgatgtttggcagccattgattctagttcgggggtgaaagatagagat

SEQ ID NO: 340828 - DNA, 235 bp, Homo sapiens
tgactagtcactccatggaatgaagaccttactgtcctttgtgttttcggtcattaattatggaataagaaacaaagcctcctattaaaaggagtttcagatatcaacaagtcagggagaaggtagaggagacaaggaatccctactacactttcttctaagggaggcttcaataaaaaacctgacttagtcttttttgagccagccgtcacagggaggggcatctagagggcct

SEQ ID NO: 340829 - DNA, 241 bp, Homo sapiens
ttgcatgcaggcagaaccacacagatcagatgagtatgcaaaacagccgttctctcctggagcacagtgtcactcaactctaaccaactgtgggcactagaacctttgattttccaagaaaagtctcggccaggcatggtggctcaggcctgtaaccctagcactttgggaggccaggcaggaagatcacttgggcccaggagtttaagaccagcatgggcaacacagggagacctcgttt

SEQ ID NO: 340830 - DNA, 675 bp, Homo sapiens
agccgctgctctgcagaggtcaagacaggcccggaagggaagctggagcagcaggtgaccggctgcccaggacgttctgtcacaaggagaacgcgagagatgaagttggtgaagactctgctttgcaggcaatctaaaatcctgggtctgatgttgcctgcttccagagctccattaaagcttcggtgaagtctcccccagcccacaggatcatctcggcattgacagtgtgccttgcaaggctggaatgcactgggccgctcccagactgctgcctgcaaagcaaaaatcccctctaccaggatgtggtgggcttcaaactattgctgttcacctgcaattccaattttgcatgggtgtctctctagtcccctcctagtcagcctcttgtggactatgggccaacattgtggacacctcttgagtcagtggccccgaagctgcagtggggtctggggtctggaccagagcatgttctcagggcaggccgagccatgctgtccggatgtgagaagggagctgtgtcaggcaggctgacaggccctggggcctgctcctggggccacagggttctagggacccattactgaggtctgggggcaccaacagacccggcctgggtgggtggccagcagcccagagccagatgcagctgcacctgcctgagtgtgtgat

SEQ ID NO: 340831 - DNA, 321 bp, Homo sapiens
ggtggccgcccgtaatcccatctacttaggaggctgaggcaggagaatcacttgaacccgggaggcagaggttgcagtgagccaaaatcgcgccactgcactccagcctaggcgacagaacaaagctctgtcttaaaaaaaaacaaacaaaaaacaaataaaagctaaccctattcccagcattgagcacagagcctggcccagagccgggatgtagtatctggctgttagagactgaattccttcaaaccattgaccaattaacaacggctgtcgcttgaagtagggctagcaaattaaaaataacagaatgcttttgtt

SEQ ID NO: 340832 - DNA, 1139 bp, Homo sapiens
gctaagtaatattaaccgtaaggacagtctgagtgcagtggctcatgcctgtaattccagtactttgggaggccaaagcaggcggatcacttggggtcaggagttcgagaccagccaggtcaacatagcaaaaccccatctctacttaaaatataaaaattagctgggtgtggtggtgcgtgcctgtaattccagctactgggaaggctgaggcgaggcacgagaatcacttgaacctgggaggtggaggttgcagtgagccaagagactgcaccactgcaccccagcctgggagacagagtgaaactgtctcagacaaacaaacaaaccccagtgagggttacagggattcagggaagggaagaggtcattgtggactggagaaatcttggaaaccttcctggaggaggcagcagctcttggcctcaaccctgaagaatggactggggaaatcacagcaggaacgatgacaggaaggaaggaaggagcatggcaatgtcccttcctaggggacacccttctattagaggactgtagtgaaagtggggtgggctgattgtggaggtcgaagggttgaagacttgagaaatagccagagggtatctgacatgatgggggagacaatggggagccattggaggttctatggcagggtgtgatcatgattaaaacagagcttagtccttacaggactagtaagcaggtgaaggaacagcaacaggagatggaacagacagaagacaacaacttccttcccagctccagcaggaattctcacttcagcctcagggactgcagaaatgtctcattttccccgttcacttattttccatttctttcattttgtgacattctgagtcgtcttaaatcttgggggagggaaagcctgaagggggtaatctgggagaggctcactcagtaactgtggtccaacaagggtgggcaaggagaaggaagttaagctggggagtgcgttcccagggaagaagccccccaggtggggcacacagcctaggggaagggctggtgcagcctggggtctggtggcagctcctccttctggcccctgccccaccttccagccacatttcctagctgctttctgcccacacccgctgtgcaccaccacaacaaactcc

SEQ ID NO: 340833 - DNA, 665 bp, Homo sapiens
catctccccatctcacagccacttctgcctaatctcctcaggccttgaaaccaagacaggtgggagccatggaggatggcagccagaggagggatgtaatctgactctcatgctccatgggccctgttcttcctctctcgacctgcaaacatcaggaagcccgaggactgagactctctgtccatacctggtccctaggtgatgccatccaggctgctggctgcaaataccagccatggactgacaactcctacattacctctttccccagaagcccagactggcatgcccactgccttctccatgtctcctctgaggccacagacccctcaaacccagcagggctgagctcctgctgcctcgagcagttccttctgtgcttgttcccacctcctgatcccagaggcatccccttaagtctgcccacttctctcgcctaccctgggtcccctcactcctgcccacacttcccatgatgtttcccctgcagctgccaaagggcacccagaacacctaggtcagattgaatccctctgcttataacctccatggctcccatctcccccggggtcaaagccaaagtcctgcccacagccctcaaggacctgcacggcctactccatctcctgcctaccctccccctcacccactctgctccagccaca

SEQ ID NO: 340834 - DNA, 474 bp, Homo sapiens
acctccgcctcctgggttcagcaattctcctgcctctgcctcccaggtagctgggactacaggctcctactaccatgcccggctaatttttgtatttttagcagagacagggttttgccatgttggccaggctggtctcgaactcttgacctcaggtgatccacccaccctggcccctcaaagttctgggattataggcgtgagccactgtgctcggcctgtattgccatctaaacaatagtaactgttttgatctatgaacatgggatgtctttccatttatttaggttttctttacttttagcaatgttgtaatgtttcttagttttgcacttcttttgtttttattcataagtactttttctttttgatgctattttaaatgaaattgttctactggttttttttgtttttttttttttgaaacagggtctcactatcactcaggctggagagcagtgttatgcagtggta

SEQ ID NO: 340835 - DNA, 427 bp, Homo sapiens
tacaacgaaagaggcagatcacaggtgtaggtgagaaggtgggaagctctcgtgattgctaactggaataaaagctgctgcagccactgtgggaaacagtccggcaattcctcagtaacttaaacttcaagttactgcatgacccagcagttccactcccaggtatataccccaaaataagtgaccgcaggtgttcaaactaaaacttgtacacccatgttcatagcagcattattcacagcggccaaaaggtggaaataacccaaatgcccaatgtttggtgaatggagaaaccagatgtgacctatcgatacaatgtgatgttattcagccagaaaaggaataaagcactgatgtatggtgcagcacggatggaataaagcgctcatgtatggtacagcatggatggaataaagcgctgatgtat

SEQ ID NO: 340836 - DNA, 284 bp, Homo sapiens
catacacacacagaagcatatatcagtcagcacagtgcctatgtattagccacttaacacatgtggacagctgggttgggaaggagtatgaagatatttgaacaagaggataaagagctgatacttattcagtagcattttcgggagctgagtgatgtttgagcctcagcaatacaaattggcaactatgtgggatgaaggttggggagggtaagagactaaagatagggagatcatttaagacagcagtttccaaactcctgggccatggactcgaaccccat

SEQ ID NO: 340837 - DNA, 189 bp, Homo sapiens
tgtttgttctcttttgatctagcttctattaattagcatatttattgagattaatctattttatagtatggatgaaagtttcatttcttttattgcttgtagtatttcaaaatatggatatatcaaagcttgcttattcatttatctgttaatgaatatttgattgttacatgctcttcactattagcc

SEQ ID NO: 340838 - DNA, 712 bp, Homo sapiens
ttcattttttcatcctcagacaggaatacattaaagcagttcagggcaaacatgagtagttcttactctcactgttagggaagaaggcaagaaatgtgtgtgtgtgtgcgcgcgcgtgtgtgtgtgtgtgcataaaaggatgcaataacaggacataaaagaaaaaatatttgaaacatatagaagtggaatagtctctggaatatataaaaatgcctacgtattgataagaaaaacataaacagcccaaacaaaaaacaggcaaaagatacaaacaaatatctctcatgagaaaaagtacaaattgttcataattgtaggaaaagatgttccacctcattggcagccagggaaatgcaaattgaggcccataataagatattatttcatatctactagacaagcaaattaaaaagtataacgtcaggttatggtgtggaggaggtgcattggggtactctcatgtactgcttgtgagaaagtaaactgatataaccacattgaaaaaagtttctcattgccttttaaaatgtacatgtccatgactgatgataagtacttctattctaaggtatatatctgagagcaggggtcagtttgctgacccctactccatggcccacaagctaagaattacttttacatttttaaagagctgtagaagcggccaggcgtggtggctcatgccggtaatcccagcactttgggaggc

SEQ ID NO: 340839 - DNA, 277 bp, Homo sapiens
ggtgctagaggtggaggcggggcattgactgggaagttgcacaagggaagtttctggggtgatagaaattccgtgttttgatgtgtatttatctacctggttgaatagtatactcgagatctgaacattttatgacatgttaaatacattaataaaaaagaagttaaaagtataagaacaaaataatgcagggattatgagagaaatagggttaagaagaaaccactaaaaaaatacatgcagctgggcagagtggctcatgcctgtaatcccaaaa

SEQ ID NO: 340840 - DNA, 355 bp, Homo sapiens
ttcattgattactgtttttccccaaggttttttgttcacctgtaaggtaatatgtagttgataagaggatgggggggatatttaagatctttattctgacaaacactttctgttgtcctaaagctgatgtggcagataggatagatttgagtcaaagaaagggatatggatttggtgaattattgtgccttattcattgaatattgactgccttcaggttgataaaaacattccatagatttctagaacctggaagacacaactgaggttttccaatttatctctttgtccacaggtaggtctttttctaaacttcatagagagatggtcatctattatcttcttagagagtgca

SEQ ID NO: 340841 - DNA, 444 bp, Homo sapiens
aggctatgtctttctaagagatgtgttatttgattctaattataattaactttgcttattactaagtagataataattttctcatttcatattttttctgaatatcagtttttctccccatagagaatattcagaagatggaatccttttaacgtagaactcaagatgtgccctgttctccctgcccgcctcccatttccctaaacacacacacacacacacattctcccttctctcaagatactttttttccaactgagagtcgttgactaatcacagatgagttaatccttccacagttttgaaaaagtctagcaaccctcaccttgaagagagtgaatagcgtggctaatccatctaagaacaatgcacgaaaacgaaaaacggagaatcctgcccggcagttaatttgttactcatacttgttgaacttaagatttggag

SEQ ID NO: 340842 - DNA, 462 bp, Homo sapiens
aggctatgtctttctaagagatgtgttatttgattctaattataattaactttgcttattactaagtagataataattttctcatttcatattttttctgaatatcagtttttctccccatagagaatattcagaagatggaatccttttaacgtagaactcaagatgtgccctgttctccctgcccgcctcccatttccctaaacacacacacacacacacacacacacaaacacacacattctcccttctctcaagatactttttttccaactgagagtcgttgactaatcacagatgagttaatccttccacagttttgaaaaagtctagcaaccctcaccttgaagagagtgaatagcgtggctaatccatctaagaacaatgcacgaaaacgaaaaacggagaatcctgcccggcagttaatttgttactcatacttgttgaacttaagatttggag

SEQ ID NO: 340843 - DNA, 811 bp, Homo sapiens
ttctccttttcacttctagagcataaaggagaaaacttggacagaagaaaacttgaaagtgtccttcaaagagcagctcagtggacgtgcccttctcaaaacactggatcttttcttttgagatgaccggggggaggggtacaaagttgaaaaagggaccccccacagatacatttgctaccacctgttgtgaaatgttgaacctgcaaaagaggcacagatagtgtcctactttcttaactagtaacagctgtttctgaaaataacagaaacagaagccaatcctttatgcaagctcacttgttgcatgtatttcagaaatctaatacaaatttacaacatctctaataaccgagttttacactttaaaaagatcttgaaaatacatacagaaaagaagtcctccttacaagcattgtttggagggaaaaatacagtacaaagtaaagagggagacacttatagataggtaaccaagattatgtagcccacttcttgccagccctcttttcacagttttcttagttctaatgtaaacaatatcccataattattcaattcaacctccttagaagcttctgttggtgagtcctgaactccaaaggaagcttcacagcacccaaagatcctaacctttctgtgccaaaacgcactatgtatgttttttctgaccctcctaaactataccctgtcccatctcaacaattggctaccctagccaacacttcttatccttgcctatcactctgctggtttaggtacttagcttaacttctaatatcggatccatcattgttttgtcaaacaaggt

SEQ ID NO: 340844 - DNA, 450 bp, Homo sapiens
aatacaaataatcacaccaaagtgaaaaagcacaagtatgtgaagtatgtgtcagcaataataagtagtctagggtaatgggctttgggtatacgtactgatgaaatgagccacaagaatacagtagtaggccaaactggtcagacccgaggtcttggtgaagcccccttgccactggaccttctactatcatccacccagattccctgtcactatacactacaaacgcagaatagctgtgatactccatcaggatggcctactaaaggtgagcagatgtcaaccagctgagaggggaaaaaaaaagaggcattcccaaacagaagacccagaaggaggaaaccacaacgtgagagcctgagccagtgtatgtcatggggaagagatgcaagtgcaaaggaggttgtcggttggagcaagggagaatggcaggactggagacaaatcaca

SEQ ID NO: 340845 - DNA, 783 bp, Homo sapiens
agtgatttctgccacaaaattaccaagttttgcaatatccatggatatgacatattttaactatgattcctatgcacaatttcattaaaaatatctgacattcaaaaatggcttaaacttaacagcactactttcttgtaacggcaaggagacaaattatgtagaagttaagggatatttacttactctaagttaccaagaaaaagaccataataatttttctgataccaattagcaaagtaattctctactacttctccccacatgctaaaatggaaacatcaatattcatactatagaactaataaccctcaactgaaagaatggcaggtaaattatacagtggatttataatgacactcaaggtacattttgacagcacattaaacacgtctgctaccctcggtcaagacagttaacgagatggccttaaaatcaacacatgattctttaggcttttcctcaaactacgtctaaaattttttgcttttcctcaaacctacttttaaacttttatgtaattttatcccacaatttccaatacaatttttttgggaaaaaaattccctagtgagaaagtagtagatggtttaaatttaaattgttctttcataaggtattttactagttataaaaaaaaaaaaagacagggggtggggagaattagtagagaataatttggcaaatgggtatcagaaaaattataagggtcttttcctgggtaacttagagtaggtaaatatcccttaatttcaacataattggtctcctggcggttacaag

SEQ ID NO: 340846 - DNA, 260 bp, Homo sapiens
ccccccaactgttcttaagattttctttttattttggttttcaacaatttgactatgatgtgaataggtatagtttactttgtatttctcatctttgggtttattaatcttgaaaaaatttcagtaattatttctttattcttctgaccattttcttctatttttctaaaacaccaagtatatctgtattagactttgtgatattttccacatttctgatactctgatttttgtttttcagcccttttttcttcccattg

SEQ ID NO: 340847 - DNA, 399 bp, Homo sapiens
ttttagacgaaattttcaattcagatatgctttcaaatcatgatgcatttgtcaaaggaagttctccctttataaaagcaagataaatagggcacttaaagaaaagtgagaaaggcaaaacttcgtctcaaactacatgtctgcatctgtgcctattaaaatctcacatactctttaaggcccaactcaggaaatctccaccaggaaaccttccctgaggtatatgctgagatccctcagcaattcataccattcccttgtatttgagttacttgtcttcaggctgaagtttccctaatagattaagaacagggcagctgagatatggcagaaagaaaagccgggctcttaacacttctaagctttgctactttgggagagtcatttcatccttttggg

SEQ ID NO: 340848 - DNA, 563 bp, Homo sapiens
gggtgcgtgtgacgggactggggtgtgtgtgacggaactgggatatatgtgacggaactggggtgcatgtgacggaactggggtgtgtgtgatggaactggggtgtgtgtgatggaactggggtgtgtgtgatggaactggggagggcacagaatggggttaggactttcttcatcctctcctgggtgtaaggagaatctatgtgctgtaaccaggcatcacttcagaatgacagtgctgtggtcaccagtgggcaaaagccaaggtcaccaaagcccctgacttcagccttctagtagtttctaattgatcaggtagattccagaagcacaaacagctccactgggtcctcctggtctatcctagcaatagcagccatgtgaccccaggccacacctagagcacagagggtggaagccacatagacattctttgacgggataagacctgtcaacaccatcctgcccagtgctgccaaggtttcccagccaagagtgggaggggggcatgagcagaaagaagcaactaaagccctgcgaccctcctgcacctccatggacagg

SEQ ID NO: 340849 - DNA, 390 bp, Homo sapiens
cctgggtgatacatagagtgagacctcaactcaaaaaaatatataaaagatggctgcaaatgtactgaacatgtgcaaactttttttcctcgtcaccattccctaaacagtgtaacaactacttacacagcatttacatcatattcggtattataagtaatctagagatgacttcagctatatgggaggatgtgagtaagtcatatgcaaacactacaccattttatattgggcacttgagcatctgtggattttgttatgtgcaggaggtccgactttacgtatgaaatatgttagacgcagtcacctacgagaaattcttgatggcttgttctttcatccctctcaatcactcacctaggtccactgagtccacctatgaatcacaca

SEQ ID NO: 340850 - DNA, 468 bp, Homo sapiens
tattttgctatagaatcatgacgacaccacttcttcaattaaattgcaaagcattcaggaacttaaagtaaatgactctctagatcactcatggggataaatttagagccccaaagagaaagcaaaatatctggtttgtgcacatgcatatggcccgtagagggtagggagagcatagtgtggggaggaagagagctgcacatggtgaaacgcagggcccaacagcaggccctggtcttaggtgctgccaggttcattccaactgctcacagtgtggatttcaaatataatccaaacagaagtgacaaaatccaaaaccacaggagcaagcactggctttcaagtgctgtgggaacagagacatttgtttaagtaaccactgttttaaaattgcatacatagtaacaccaaaataaacagcttgcgatgctgtttattttaagatacacaatagtaatgtaaagtgtg

SEQ ID NO: 340851 - DNA, 500 bp, Homo sapiens
tttgcttcgccctcttctagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaagaatgagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtgg

SEQ ID NO: 340852 - DNA, 531 bp, Homo sapiens
tatccagtgctagctgattattaaacttactgggggagcttgaaaaatattagtgctgaggcttcctcatttaactggtctagagtgaggtccaggcatgatttgaaagcttcccagtggtacaaggttgagaactactggctacagggaagaactaactttctctggcctctacccacctgtctgacttttacctttggccacacatttccttccctttgcatcccaaaggctgaagtgcttacggagtcaggaacacacagagctggttcgtgctctgcagctctgcccaagctattctccttatcagaactgcattccacctctgcaggccacccctgcctggcccacctgaaaaacccctcatctttaaagaaccggctgcgtctcacccctcctgcggtcttctcgcattgcccatatttgcatagtcatctaccatcatcacatcatcaaggctggcccaggcctgcggaatctggctgctccccgctcgctggctcctgttttgccccatcccccgtgctccag

SEQ ID NO: 340853 - DNA, 163 bp, Homo sapiens
atatatatatatatatatatatatatatatatatatatatatatggagttgtatagaattgtaagctcattttctgagcgagcacgaacagataggagtgataactttcctggccctacagtcctctagcatttccatccccttagacaccctgctaggacag

SEQ ID NO: 340854 - DNA, 314 bp, Homo sapiens
aagagtcattatgaaactcaggtaagttttatcatgaaagaatgctgaaaaaaaaaatcaatgccccctggccctcccattgagtaagcaactgaaagtgagcttacagcctgtgtaggacatcttttaatttgccaagtgactaaatgtgcagtcactgcagcaggcatccaccagctgtgcccacatggcccactcagctgggctgcttttcaaagagcagacagggcttatcttagtaccaaaactccatgccaaaaagatcatcactgggtttgagcatttgcacaaaatccccagcagccacgggtaga

SEQ ID NO: 340855 - DNA, 132 bp, Homo sapiens
cattggaaagacttttaattctaaggtttaactttttgaaaatacaacctctgcagaaactatagttcatcataaaggggcagtaaacagaaatgagagtggggaagcggttatggggtaggtagaaatctg

SEQ ID NO: 340856 - DNA, 239 bp, Homo sapiens
ggtgccatgttatatcggattttgcagaacttgtttgatattgggaccatagcgacttgagaaatgcggacctgtagaattggctgcacttgaagtattttctaatctctgatgatgctcgacattaattgattatatttgctgacattctcttctggattttgcaaagttggactgttacatcattgcaaaaataaattatctagggacttttgagaacttgtggttcaactctaaag

SEQ ID NO: 340857 - DNA, 438 bp, Homo sapiens
tcaggctgagtgaggggctgaggtaagacccctcctggactcaggaacaaaaaccaagccaaagaaaaggtgagactccctcccttgatgaagaaaactgccccattagaaagtaagagagagtagctcagtgtgccaagtagttctgagcagagaactatccatgagcctgaaagagggcgcacgctggagtcgctggagaaggatggaggtgatgtggttttggtagtttaacagatcagaggtttcccaacctgctggaaagaaggggggtctgcctggagatggcctcaaaactggctcaagaataagatgagtggtaaggaattctccttacaggacacctacggaaaacacatttagttgaaagcagagcatctggtaaattctaaactcattttgtgacaatttcacctctgaggtgatgcagatgtgatc

SEQ ID NO: 340858 - DNA, 488 bp, Homo sapiens
gctatagctagataaaaataaataaagaagattaaatctttattttgctgcattctttccttaggatacacagaaagaagccatgttactgtcctgctgttcattaagtcaattagccattcccgactgcgggatgacataattttccataaacagtctcttacgcaatggtgtgggttggtggtgtagaagtagatcacataatcaacttaaagcagttcctttatttaaattaaccatttgaaatcatgtgagaccttatctcttaaaaatatagatactcgagtagctatattaatatcagataaagtggacttcagagaaaagaaaattaccagcaagaaaaagagacatcacatagtgataaaagaacgaatctaccaaggtgacatagtaattttaaatgtacatgcaccaaacaacagtttcaacacacacacacacacacacagatagagctaaaagagaaaatagacaaatctatagtt

SEQ ID NO: 340859 - DNA, 398 bp, Homo sapiens
ctcatgatgtgtgtgtcattagttctcacaattctacgatgtctccttcctcccacccacagttttaaaatagtacggactatagttgtcatagttttacaatgctctgcaatagttattattcaggatgggggaaatcaagattttagattatttgaagatgaattggttttcacagctctgctgttcactggctcctggtgggacatttgtggctttgacaatgtttcctcaggggaacatggggaattgataggctttttctcagacccttctggccgtgaagcttgatattctttcctcagtgtcgtgacctccttgtgggcaagaagtttatttccttagtgttttctggcacatatggatctcagtaaatatttcctgaataagtacggtca

SEQ ID NO: 340860 - DNA, 159 bp, Homo sapiens
ttcatttcttatcactttccatggcacactcttaaagccaaggaagataaaactagaatggttataaatatgaatggagaaattcagttccttccctatcatatttacatgtctcaagtaaaacacagatgagtggcaaaaggtctactgcattctctg

SEQ ID NO: 340861 - DNA, 532 bp, Homo sapiens
ctggtagttgggggagaagacatgagttttggagttcctgagagaggtaggaatagacatgagagaatcatgaactctaagaaatagtagagactgtagaagtagatgagatcacctgagtaaaatttataaaatggggaaagaaagggggttaaggatagagcacagaggaactctgatatgtgtggacagaaaagttagggagggagcctgaggaggggcaatcagagaggcaagagaaagtactgtctgggaagccaggaatgagaaaagtttctaaaagaaagcaatagtgtctgttgcagcagagaacaggtagggtgagcctgaaatgaggctactgagtcattggtgaccatggtgacagcagtttcagtggaggggtggggacagaagctagactgctgtggcttagggagtcagtatgaggcaaagatgtagaacaaaagacttttttgagaaatatagttgcgagggaaggaaggaaagagggtggtattttgaagaggcagcagaggaggcaggttcaaag

SEQ ID NO: 340862 - DNA, 408 bp, Homo sapiens
atcaggttgagagattctgcttggtctagtcaatctgaaaaattcaggctggaaagacaccttttctcaagagttgaattgctttttgccttcaagtcttgcctgcaccttgcttacaatggcatcaatttacacctaaggacctttgaagagaaaaattccattatttcttttttttcttgagagcagattttttccctcctcctttggaagatttgcagtactttgcttccatctgagccagaaaattgtccatttccttttgccaatccttttgtctgctctgaatggctgccttcaggctatccacgccttcatcaagccccaactcctttctgctcatttctgcttctttggcctcttcctgagccctccttttctttgcattcatcttttgtgttgattctt

SEQ ID NO: 340863 - DNA, 351 bp, Homo sapiens
gcatctaatcacagactataaactctctattagctatagtgatctctggcagcttaaaaaaaacaaatctgggttcttaaattgtgaataatatttatgtgaattatcaagtgtactgcattatattttgcacccatatattgagaaaggcagcatccatgtttctaaaagcatgcaaaaccacggcactattttaagaggacagcaaggcccgtggaaggaccactgccttggttttctttttggtgcgccattttggcatgtgtttaggattatgcctgtctacagaactttccgtagcatcttttattccttccgttttctgctttaataagataagggcacatttct

SEQ ID NO: 340864 - DNA, 522 bp, Homo sapiens
actgacgatcgcactggccatacttttcgtttaggtctctgttacctcttgtctgttactacagacaaaacacctctcaagcattccaatctctactaaaaaattagccgggcgtggtggcgggcgcctgtagtgccagctactcgggagactgaggcaggagaatggcgtgaacccgggaggcggagcttgcggtgagctgagatcgcgccactacactccagcctgggcgacagagcgagactccgtctcaaaaaaacaaacaaacaaacaaacaaaagaaggcagccctctccaggttcgcacgtgctgttttctctgccagaaacacgtgtctcctttctctgttgcttatgctgtctcatgtcatcacctctgagaagccttctctgatgtccctacagatcaggcttggctctccagtcatatggttacacagcatcctagaggtccccttttagttgcacacctgcagtggttaactttgtcttccctctcccgtgactccatgattgttgaggt

SEQ ID NO: 340865 - DNA, 205 bp, Homo sapiens
caatcatttcaggggccagggtcactcgggttgagcttttctggtctagtccctcgtcgccaagttgcagggaggctcactggggctcagatcggaagacattttcaccaagttaccctacgaatgtctgagaggagtgagaaggtgtgcctgaattcttacatgggggcctggaggggctaataggaagggttggtcttatcat

SEQ ID NO: 340866 - DNA, 302 bp, Homo sapiens
tgagggagcggatgggtgagcggatgggagagcgcatgggtgagcagatgcaagagtggatgagagtggttgagggagtggatggttgagtggatgggagagcagatgggtgagtggatgggagagtggatgggtgagcggatgggagagcagatgggtgagcggatgggagagcggatgggagagtggatgagagtggttgagggagcggatgggtgagcggatgggagagcgcatgggtgagcagatgcaagagtggatgagagtggttgagggagtggatggttgagcggatgggagag

SEQ ID NO: 340867 - DNA, 832 bp, Homo sapiens
catcttcaatccccaactccctttctcttatgtgaagactcaatgagttactgacttataacctctaacactataaataatccactcaaagtcttctacctaaaaccattccttattttctgatattacccatttcttagatgtttctctaggataattataattaatgtagtaagatctgtggcacttcacagtttgccaagtgctttctaaatgtactcacttaatccttacaggctgtggaaaaggtaattccctctattttataggtaaggaaaaaggaccgaagaactcactaccatgtcgtatcaacaaagcaagttggtggcaaaccggacctccgaaataggtcttccaactccacacggcatgctcgtcccattctattatgctcttttctaagaagggaatgtctacagttctgtcccaaaccacatttgcttcaagagtaaaccatcttcaaaccatttctctaaattgcaatcaggtcccccactcctacaatcatgccatttcttgcttcctcactctccagctatgacttccttctcactacccgatttccactcttcatggatactgccatcattccttcaacccgtcctgcaaatatcccacctctacatgctaaagggagacccctcatgttccttcccccaaaccctggcactcccttctccggatatgtaggttgtcaccccataaactacacagtagcttctcgcttctcggcccttaacgagctacttactaactttaaaagccccacagaaatgaacttaacttgcaggtcctccacctccacacttggccctgggcgccattcctctga

SEQ ID NO: 340868 - DNA, 380 bp, Homo sapiens
tgcaccttccacaatgtctaatataattctgggcacagagtaagtatttaataagtattcttgtctgaatattattgaaaaataataatatattagatggctaatctggtagaggaaaatcagaaaattgattcaaaggagtactgactgaactgactattcaattgacagaaatcaggaaataatttgggaagcaaagacacccacaaattattccattgtatatagatcaaacatcataagaaacaagaaattcgcaatcattaggtaattttgcttcatgaagatatttgattgttaaattaatatgtgctattagtaaagttgaaatttcagaagtcgggagagataatatcacctctgtccttatacctcactat

SEQ ID NO: 340869 - DNA, 277 bp, Homo sapiens
tacaagggcacactcttacataaacacgatctaaggctcacattcaggaaatttaacactgacataatattattatctaacatgcaatctgtattcagatttctccaattgtcctaacagtgtctcttatagtttcacagaaattcagtcttgaccaggtgcagtggctcatacctgtaatctcagcactttgggaggctgaagtgggaggatcgcttgaggctaggagtttgagacgagcttagacaatacagcaagacctgtctctaaaataatt

SEQ ID NO: 340870 - DNA, 318 bp, Homo sapiens
gagaacaaaaaagaacttgccttttgaaagagggagataaagtaggaaaaggactacagcatgtccattggcttgtgggatggaggggtctttgatgacatcagggaaatgatggagcagaagcggcggcagggctatgaacgatgagcaggagggagccacagcacagcaagtgtagacaccgcctaggagaggcccaactgtgatgctaaagggaggaacaggtctagaagttatcgattcgcttggaataataaatgatacagtggcgaactgttccagaaagaagttaccaacagtcgccgctcactaggaaac

SEQ ID NO: 340871 - DNA, 475 bp, Homo sapiens
actgcaagggaaacacctcagagctcaatagccaaagacgcaccatcaatgttgaatgagacagagtctctactgatgggaaattctacaagactcctctggtgttttctgtgatatctgttccagccccacagtggccactttcagttctcccccactattaacactcatcctgccaagccaagaattcttaaggtagtgtagtgaacgccatgctgaaaaataggctcttacggtgccggggtccgtgaacacagctcaccactccgaggaggaaaccttcccttagcacaggcaccacctcctcagacagtcccacaaatacaggaaggtggtggctccacccagggccacagtcattgtctccaccacagtcacagaacacgcccaatccactgccgacattttgaagaaagggccgcaatcatccactgaatctgtcctaccaaggaaagcaaatcaagcttgctgccct

SEQ ID NO: 340872 - DNA, 410 bp, Homo sapiens
gaagaatgcatgttgcattttgccaagttgctctcagctttttcctgcctgtatgccatctttctgcaaactaccagcgctggccgcctcgcacagcgataatcagcctgtcagtcaataaactgaagatgttggtggtgtgctggggttggtggccagcagtgagagccctgagagttataaattcaagatgagaattgagatgttgccaaggcttcacagagtccctgatttactaggaaattgttccctagccttgactgctggccctgttatgcaagggactttgtgtgggctggggggatggttgaaggaaagacaaaaaataaaagaccagaagccagtgtttaggcacagtggataggacattccctaccccactgcatttggtcacctatggtctgctattt

SEQ ID NO: 340873 - DNA, 355 bp, Homo sapiens
acacacacacacacacacacaaaagcagctgctggtttccaagggccttgcctggaatcagtccagaagctaaattaatgttaattgatattcctttatccacagaaagacagcaagaaaggtcatgcggagcgggggacataactaaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataagg

SEQ ID NO: 340874 - DNA, 512 bp, Homo sapiens
taggactgtagccacttcaaagcaagtgtacacagatctttggtcagaggttggtaaactatggctgcaggccaaattcagcccctgatctgtttttctgtggcctgtaacataagaatggttttactttttttttttttccaaatagagatagggtctggttctgtcgctcaagctggagtgcagtgacgcaaaggtagctcactgcggccttgaacttctgggcacaagcagtcctcctgcctcaggctctagagtagctggctgggactacaggcatatgcagccatgcccagctaattatttttattttttgtagagatggtgtctcactgtgttacccaggcaggtctcaaactcctgagctcaagcgattctcccaccttcagcctcccaaagtcctgagattacaggcatgagttactgtgcctggcctgcctttttaacggcttaaaagaaatgaagaataggcgacacagagcacaggtggtctgtaaagtctaaaatatgta

SEQ ID NO: 340875 - DNA, 370 bp, Homo sapiens
ctggtttatatcttgataatctttgtatgatagatctactttaaaactcaaccaagagggtttatctgaaatatcaaaaagcctttgtctttctaaaaacaagtaaaaaaaaaggcctttgtcacattataattttatttaaaccacacccaatagcactgaaccaaaggacaatattctggcagaatgacagtggcagtggtggcacatacatattagaccttttactttcttgcatatcatttgtctcacctagaaaacaagctccacgtcagcagggattttagattactctgttcatgctttatccctagccctggaacagtgcttaattatgttctggggactcatgaatatttgtcagatgaaa

SEQ ID NO: 340876 - DNA, 235 bp, Homo sapiens
cctgatttcaccaattttagcagtctagaaaatgtgactatacaacagtaaataaaagttaacatgatcaaagaactcaggagacaattctttccttgttcaatctgctgtctccccaacccctgtcaagataaaggagagggaggtggacaggttatggctttaccatttataatcaaaccacagacctgggataagggcccttcaattcatcctcccaactgtttaaaacatg

SEQ ID NO: 340877 - DNA, 341 bp, Homo sapiens
accccaagacattatctcttgaatcttgggaatcttagaaacaatgtagctgcaaaaatattatttgaaaactggaaactactatcctgtattattctagatttgtttattgaattatttacatttagcagtaaatttgttgcttgaattgtaagctgtaagaggcactttgccttggcttgtttcatgtaatctttccatagggttatgtaaatgtcatcacatgcaaaatatttctgttgtgaatgatggagagatttttcaactgctactgacacatgccctttaatctatcttttaaaactaattcaagttttagtcattggcttgttttcattccc

SEQ ID NO: 340878 - DNA, 231 bp, Homo sapiens
cccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattcta

SEQ ID NO: 340879 - DNA, 644 bp, Homo sapiens
cacacatgctgttgtggcctgtgccacactaacctagacttgggactgtgcccttttctataatacatacatgtacacaccctcctcacatacagttattcatagtgtacagactactgaaactttagtgtacctggaaggactcacatcttaggacacatacaacttaaaattcaaagttcaataaaccagtttctaaaaatgccccgtcttagtccttttagtgttgctatcacagaatagctgaagatgggtaatttattaagaaaagaggtttatttggctcacaattctgatggctggaaagtccaagattgggctgctgcatctggtgagggccttaggtagcttccactcatggtggaaagaagggaaggaaaagtgcaaagagatcacaagacaagaaaaagaatgaaactggggaagccagattctttaactacttgctcttgcaggaactaatccattcctggaagattgagaacgcactcactccctcaggatggcattagtctgttcattagggatccatccccatcctccatctcctatggcccctccccaaacatttctgaaatggaagccctagacttctgatcttaactagatccatttttttttttttcttagacagaatctcactc

SEQ ID NO: 340880 - DNA, 2131 bp, Homo sapiens
atctccgtccggggtcagtcagtcgctccctgtcgctgccggagagtctctgcttcccccttcctacgcgctccgcggcggtagctcgggctctccggaggagggggcgacagagaaaaagagaggctgacttaataaagtttcctgaaacaacaactaccaccgaaaaggcccaaggtggggggagacccccattttcctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagc

SEQ ID NO: 340881 - DNA, 2764 bp, Homo sapiens
atctccgtccggggtcagtcagtcgctccctgtcgctgccggagagtctctgcttcccccttcctacgcgctccgcggcggtagctcgggctctccggaggagggggcgacagagaaaaagagaggctgacttaataaagtttcctgaaacaacaactaccaccgaaaaggcccaaggtggggggagacccccattttcctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctggtgaggaacagttaacagagttttgcttttttccccccatcgaacta

SEQ ID NO: 340882 - DNA, 1576 bp, Homo sapiens
atctccgtccggggtcagtcagtcgctccctgtcgctgccggagagtctctgcttcccccttcctacgcgctccgcggcggtagctcgggctctccggaggagggggcgacagagaaaaagagaggctgacttaataaagtttcctgaaacaacaactaccaccgaaaaggcccaaggtggggggagacccccattttcctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcagatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgacttttgcaaggtgttatc

SEQ ID NO: 340883 - DNA, 2414 bp, Homo sapiens
cagtggtgcaatctcggctcactacaccttccgcctcctgggttcaagcaattctcctgcctcagcctcccaagtagctgggattacaggcataagccaccacacccggctaattttgtatttttagtagagatggggtttcatcatgttggtcaggctggtctcaaaactcctggacctcaggtgatccgcccacctcggcctcccaaagtgctggggttacaggcatgagccaccgtgcctggccaaaaaatactacttgttaaagaaggttttggaacaaatgtagatttttaaaaaatgcaacataaaatgagtagactccctatacttttcgcaagtctatatatattttaaaagttcaccttctatacctgtgtcccctgtattaaggcatttaatgtatttaatgagtattaaattagtttcagattcaggttctaaagcaaaatattagtttgagtgctgtgagggttaaatgttgtggtttgattatcacacgtttttttatttgtgtggaaaacttgagatgaaaccatcttttagaagtaatttactgttgcatagttttaaaaactaggttttattagtaaactcaaaagtgttcatttattcccatttctcctcagataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgacttttgcaaggtgttatc

SEQ ID NO: 340884 - DNA, 4502 bp, Homo sapiens
atctccgtccggggtcagtcagtcgctccctgtcgctgccggagagtctctgcttcccccttcctacgcgctccgcggcggtagctcgggctctccggaggagggggcgacagagaaaaagagaggctgacttaataaagtttcctgaaacaacaactaccaccgaaaaggcccaaggtggggggagacccccattttcctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgacttttgcaaggtgttatc

SEQ ID NO: 340885 - DNA, 3269 bp, Homo sapiens
gagagtatgaggcggactcggttaagtcatacgggacgggtacagatacaatgaggggccgtcgagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgacttttgcaaggtgttatc

SEQ ID NO: 340886 - DNA, 668 bp, Homo sapiens
cccccccccccatatgaaatcctctttaaaaccttcagttttctacatatcacagtaagtgcttggtaattcaatgttatcagcaggaattgtggcagggttccttccactgtaggtaatcagtaaacatattttcattgaaataataatgtaaaagttggagacaattccgacatcacttatacttaagagtggaatgcatctgaagtgtgtgttgaaatatggatgatgattctgggggatcttggagattcactgagccggaaacaatataatatatcatggtaagagaatgttaacactcttggcttctctgttctgcctcctccatctaagtccctttcctgttattcactttgtactgtgaaaaaactagactacctcttcagaagcaaaggagcagcataaaatgaacatgaacactgccatggataaatttgctggtatgcaccatttcctaggcctagaagatagcgacattggtctaatatgttgcctttttaaaagagttcctgtcgagttggaatagcttgtagtcacaaaacattacagttggtgactgaagaacaaggatttaaatcagctctagctggctccaaaggttatgttctttccttagaaccaaacagagtttgacttctttgagaattatctagcttcttctccta

SEQ ID NO: 340887 - DNA, 346 bp, Homo sapiens
cccaacaagaaaacaaaacatacagatagatttaacacacagtaggcactcaaaaaagctcatggattgatgggtaaaattcacgtaaatagctgaggccacgattgaatattaatggaatgcagatgaaatagtattaaagatatttaatcagggaaaaagcatattttcctgattaaatcctatgtatatgcagctagtattttctaaagggaatgaaagtacacttaacgcacaaacatcaaaatgacaagtgctatcatttgccattttagcaatatttagctaaatttcttttttgttttgttttgttttgaggcggagtttcgctcttgttgggagcttg

SEQ ID NO: 340888 - DNA, 147 bp, Homo sapiens
ttaaatctacacagcagggcctagactcctggttcaaagaaattaagtttatatccaccataagccagatctttttctctctttgaactcttgactctgtgttgtgctgttcccactgacactgtaaattaaaggataaaatggtgc

SEQ ID NO: 340889 - DNA, 269 bp, Homo sapiens
cccttccccccaggtatgacaggtgactgggagacagacagagtgacaaatggaatgagcatgggctttggaatcaaagatactcagccctaccacctactagatgggtgacctggggcaagtcactttatctcatggaacctcagtatcttcatacgaagaggggacagtagtacttagtgcttggtacacaatagggacttacaaaaaatagccactgttcctgtgatgaaccaagagaagaaaaccccataaacttaacaccatag

SEQ ID NO: 340890 - DNA, 218 bp, Homo sapiens
ctcatatctttagcaagggaagggggaaaatgatcattttgaaatgttttcagtgtgttcttcacaacaatttgctctgctcaagtgaaaaagacttcagcagaaccttatctcatataggcagaggagcaatacccaattccagatctctttagccttctatctcactcgaggagcaagaagaggggaaaaaaagaagttgtagtgaaacttacagc

SEQ ID NO: 340891 - DNA, 478 bp, Homo sapiens
ccatgctcccaggagctctatgatgctggtattaatatacccattatacacattaggaaactgaaactcagagatgtcaagtgccttgcccccaaccagacagctggtaaagacatgaattcaggtatgcatgtctctagacatgttgctttgtatcaaatacaaataatacttctttattatagcacgtactcctgacatattattttgcaaactgtaaacttctttgctgttcattcacttgtttaattcttactacagccccactatcaattctatttgtgagggaattaagtctagaaaaattagatacaattgctcaagattccatagcctggccaggaacccaggtgttctattccaagtgcagggccatttcactgcccacatatccatgtgccgggctctgttccatgctaacctgaagtcccctgagagaaagcctgtgtttgatgctgcttctgtatttcccactgat

SEQ ID NO: 340892 - DNA, 208 bp, Homo sapiens
agatgctcccaatttggtgtggtttggagtgtaatttagatcaaacgtctccatgtaaatgagtcagggtttcttaattaggtgcctctaaagcaaaaccttggaccacatcagtaggtgtgggtgtggtacccacaatactggaatctttcctatagaccaggctctcagtatcattcaaataaagcttttttttttcttttttttt

SEQ ID NO: 340893 - DNA, 645 bp, Homo sapiens
agcggattgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctcc

SEQ ID NO: 340894 - DNA, 568 bp, Homo sapiens
ctcccctcccccactccttctcctctcctcctcgcaggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctcc

SEQ ID NO: 340895 - DNA, 627 bp, Homo sapiens
cgtggtgcttgctcccgaatcagacgccggcagccaaacttgtcccctcctgtagagtaggaagcggccgggcgccggggctgttgggggtgccaggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctcc

SEQ ID NO: 340896 - DNA, 218 bp, Homo sapiens
acaggaagcaaaatattggcaggacagctggcaacgcggcaatgtccaggatggagtgcccatcctagaggagggagctcacacaagccagccaggagcccacaggaaacagagagactactgtaaatccttattaagagcagactcatctctgctatctaaaagataaaaacctgataatgtttttaagttgtcctaaggtccaattgacttttttt

SEQ ID NO: 340897 - DNA, 356 bp, Homo sapiens
cgagctcggtaccccttgaatttgcaactgaatggtattgatcagatctaggtacaggtgtagattggatgcgtccttgtttagtctcttctatgtaacattttcttggacaggttgagcacttggtagtggatctgcaaggagggggtgccccctttagtctggaatcccctcttgattcctaggtttgctggcatttatccagataggggcagagtcttcctaaacggcttccctcctttggagtctgctgctccttgcatgccataacccagtcttgagaacctggctcaccttccattgctcccctctcccattcagttgcaaattcaagggggatcctcatagagcgcgca

SEQ ID NO: 340898 - DNA, 405 bp, Homo sapiens
gctggcatttatccagataggggcagagtcttcctaaacggcttccctcctttggagtctgctgctccttgcatgccataacccagtcttgagaacctggctcaccttccattgctcccctctcccattcagttgcaggttgtggccacttcgtgccctatctctcttctgtggtgtcccttgaatttcctcctttttacttcccctggcaactcctccgtatgtcgctgtcccagcctctcaagtgattctcccatcttcagttttatcctctctagactatctccctattattttccctaaaacacaaccttgatcatgctcatgctcggtcctaaattgtcaacggtttgcaggtgctaccaaaaacaagtctaaatgtcttagatcaaccagtgtcaccaa

SEQ ID NO: 340899 - DNA, 334 bp, Homo sapiens
acctgtaagtgacttagcacagtggctggcacatagtcagtactaaacgaatactagctgctattcaggaagcattgctggaaagattaggagggaagttttcatccaagtggaactgtccagtaggtggatgaagatatacaaaaatctggaattcaggaggcaagcctggggagaagttacacagttgagattgtcaatgtttatggatggttttaaaatcactttgttatctatccctgaatgtgtatttttaaatgtggaggtatttctggttaccaaaataggcttaaagcaggagtccccaacccctaagccgtggaccagtggtgac

SEQ ID NO: 340900 - DNA, 243 bp, Homo sapiens
ggtgggagacacttctgcttccatagtgaacacatattgtaccctcagccctgttccaggctctgtgtctcagattttattctgttttcagtatgggggatgttacgcatggggaaacagaggcctggaagttagcctgatgctatcgtttatagagataaattatatatagatatggaacatataccaggtgcccttggaagcgcccccttacatctgatttgtgtaattctcatgtcagtt

SEQ ID NO: 340901 - DNA, 1048 bp, Homo sapiens
tgtaccaggttggaaagtggtatgtgtctaattgcaggggcgggggtaggggggaggccagaggattaacactctttaaatagacatcagaaaactaagaatagccttgctgcctggtaattgatgggcattcctgactacgggccacacactcagtaggtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggttgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctc

SEQ ID NO: 340902 - DNA, 464 bp, Homo sapiens
aaatggattgcagggagaacaatggaagcagggaagagaccaattaggatgcttaggttcagatagaagacaacaatggtttagaatgatgattggtagaggatatgggcagaggtaagtgtattcaacttctattttagacatagcatctgtagaacccgttagtagataaaatgttagggaaaggaagtaataaaaaatgatccttggtttttgtttgggtgggtggtaatgttaatttacagagataacagactgaaggaggaccactcttaggtgtatatgttgtgggggaatcaagaactctgttctagagacactaattttgaggtgtctgttagacatcccaatgtatcaagtaggcagttggctatgtagtcagatgatcagagaagagatgtgggttcttggctttctttgacagtggacctataattccttgcactcttttatctctttggttt

SEQ ID NO: 340903 - DNA, 683 bp, Homo sapiens
tgtccaatttaagtccatttggggtcctctgcacccgtacaggctggaaagaggaggacacaagtgcaggtctcagctactctctggcccagtttcttaagagggtgcaggcctgatgcacagtgacagtgggtggcaagaggagccacagacgggacatgcagaacactccagggaagcatgtgtcatgacatatcaacagcaacagggtgacttggcctcccttcccctcccagggagttacaggctgcagcttccctgcccctgaccatactcctgggcagtgtggctggttcaccctggaggccacatccctaacagcatgccaaggagacgtgaaagagaggccagatggaggtcagacccagccagggccccaagacacctaaagcagaggtttcaactacaggaggaagaaaaagcaaacaccacgtggtgattgcatctttctgcttcaagggccactttctccagccctccccagtccacatcccacagggcctgggtcggcttaagttttcagtacttcaagaaaagccagaaagctgtatttttatgccaaatctccaagtttttaaatgttcataattcacaatctttaaacctgttagatagggcacacaaaacacctgcaggttccattcagccccacaggctgccagtctgcttacgctgcagtgatt

SEQ ID NO: 340904 - DNA, 474 bp, Homo sapiens
agtggaggcaatacgactaaaacatggtttatacttgtccatagctcagtcattaacatcatttggaatttattcttacacccatgattccttaaaacaatataacgaacataatctaactttcaactagcaaatattcaatatcctatcacagttctttggggttttcttaaaatttctaactcctaccttcatgtcaggctataaattgctaactttcctgacgtcaacttacatgcctcagaatcccatttcttttccctccctagtctcatctgctttaagataacaaagctagtaaacataaggagacttaatggaagtccaaaaaaggatcagaaatgctatgcaaaaataccccccggggcgtcgggggaccagggagaggaggggacatggctttgatagcaatttcaagcagtttttgggctccttacattccacagctggtttaacctctggattaagtggagt

SEQ ID NO: 340905 - DNA, 303 bp, Homo sapiens
ctcagccggtaccattgctcaccgctcctgggctgtgcacaaacccactcacgcacacagcactcagtaagccgggactgacccactcagacacgcacacaggcgcacatcacacacaggctcagccccccaaacccagacccaggagctggagcgtacgggtccacgtggctagaaaatgcaggttggagcggcccccatgccgcccggacccccagcccaggacatcatggtgcccagagagcgtgagccccaagggcattggcaggagctgccgattccatctccctgggtgggttccag

SEQ ID NO: 340906 - DNA, 1242 bp, Homo sapiens
cgcccccaggacgacatctactccccgagcagcagctccaagatcccggtcaagtggacagcgcctgaggcggccaattatcgtgtcttctcccagaagtcagacgtctggtccttcggcgtcctgctgcacgaggttttcacctatggccagtgtccctatgaagggatgaccaaccacgagacgctgcagcagatcatgcgagggtaccggctgccgcgcccggctgcctgcccggcggaggtctacgtgctcatgctggagtgctggaggagcagccccgaggaacggccctccttcgccacgctgcgggagaagctgcacgccatccacagatgccacccctgagtcctcacgtgacccaacgctctgggctccagccaggccagcccctcctccctgcagagcgccaactcgaagggatgccggtctgccggaccgaggagcctctggctgtgggcctcaggccctggcgtgcacacatgttcgtgcaccaggcagacgtgcagacggagggctggggctgacgtcccccgtgcagtgtgactcgtgcagacggagggctggggctgacgtcccccatgcagtgtgactcgtgcagacgaagggctggggctgacgttccccgtgcagtgtgactcgtgcagacggagggctggggctgacgttccccgtgcagtgtgacacgtgtccctggcctctcaagagagacaacggcacaggagggtgggtagaagcctcggaggctctgggtgaggaaccctgagccctgtgtgtctcctgcctgggtcccctggactccctcccagggtgaagagccaaaggcccagttctctccctagtcccagcttgggtttgtggaaatgaccagtgctgactcccaggcagaccgtggtgttgaccccactggatgtgtggtatgtaggcacggggtggcaccgtcacctgcccctcacagacacactggcggcctgtgcacaaacccactcacgcacacagcactcagtaagccgggactgacccactcagacacgcacacaggcgcacatcacacacaggctcagccccccaaacccagacccaggagctggagcgtacgggtccacgtggctagaaaatgcaggttggagcggcccccatgccgcccggacccccagcccaggacatcatggtgcccagagagcgtgagccccaagggcattggcaggagctgccgattccatctccctgggtgggttccag

SEQ ID NO: 340907 - DNA, 234 bp, Homo sapiens
cccggagtaggaaaaaagacaacagaaaaaaaggcagaggttggaccgcactaggtttcatcaagaaacctcgatgattcctctttcgacactaaccactaggactaaacaggaaaagaagcttcgtgcttaagcaagtcccatcatggtggtttaagagtcactaaattaagctgataatgagtccaatccacagagacaaatacagggtgtggctgctgcgaaatacggcgg

SEQ ID NO: 340908 - DNA, 1562 bp, Homo sapiens
caaatggccacatatatcctaatgtacttgagaaatctcgctactaatgctgtgtcactaattttttaatactgtatttaagaaaaaaaaaaagcctgtcttttctattggcatcattcaagaagaaaaaaaaaaagctgaatcaggatatttctgtgtgaatgcacattcctcactaaatctctcaggcagctgctttagtcactgttactaacaccttgctctgtcatctctttgtacacatgtctaatttatcagtttcttgtagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340909 - DNA, 4575 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340910 - DNA, 894 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtgagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatct

SEQ ID NO: 340911 - DNA, 1319 bp, Homo sapiens
tgttctcaaaatctatgcaaaaatatctcgtctaacccctaccattgtgcctggccctttgaaatgtgtttcttgctgacgtgcttgtttctcctttccagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340912 - DNA, 661 bp, Homo sapiens
caaatggccacatatatcctaatgtacttgagaaatctcgctactaatgctgtgtcactaattttttaatactgtatttaagaaaaaaaaaaagcctgtcttttctattggcatcattcaagaagaaaaaaaaaaagctgaatcaggatatttctgtgtgaatgcacattcctcactaaatctctcaggcagctgctttagtcactgttactaacaccttgctctgtcatctctttgtacacatgtctaatttatcagtttcttgtagattgtcagcagcctgctgcctccgtaccgccacagtgctcacaactagccgggaggcaagactgcccaactgtcaggtaaattcagatgtcctttcccttccacccagctgcatgtcagatccatagaccccagctcccctttccgacacctgaactgcctacgcatcattgtattttgctgtattttatttcaagtgtgggctacatagacacacattggacacctgcagtccctgcgttcccagtaggaatacaagagagctggggtttattttgctggctgccagctggtagactctacaggctgccttcagcccctttgtctgtgtaaatacttggattagtccactgtttcattcctttccaaaaaataaaagctggaattgttatga

SEQ ID NO: 340913 - DNA, 4437 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340914 - DNA, 5075 bp, Homo sapiens
aagcaagtaacaatgtttttcaagttttctttaatgcattacatctttttttcacaagatattttaaaattttatttttccttattaagcgaattgaattatttcaagcatcagtgagagctgctagactgttatatttcgggggtcttgcagggtagcttttcttacacatataagcagaagaaaacattttcccaagtcttaaaagagggttatgatgcatttcattgtgtactctttttcttcccatatactctgcaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcgatcttcatagtacggtgcagtggccagattttagttaactgcaaaaataaatgtgctcttgttgtggaggatggaggaggggaagcaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggcgttaaaaggtaattaaagtaaaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340915 - DNA, 3349 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggcttggggtatttgtcacaaacaataaatgattttgtatttctgtttcaaaaaaaaaatgataaagaaaaggggggggggcccttttggggagagggggtactcccgacgacaacaacaccgttatgtggaaatagggccgcaggagcaattacgtggcacgcagccgga

SEQ ID NO: 340916 - DNA, 517 bp, Homo sapiens
tctgtagtctctatgaatcttctcatttacttaaggattttttcataggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatcagaaatcagcaaatccagtgagttatggatacttaaaattacttaattctggaaaaactttgcacagtcaatggacaaacaaatctacaaacaaaactgaggcttggggtatttgtcacaaacaataaatgattttgtatttctgtttcaaaaaaaaaatgataaagaaaaggggggggggcccttttggggagagggggtactcccgacgacaacaacaccgttatgtggaaatagggccgcaggagcaattacgtggcacgcagccgga

SEQ ID NO: 340917 - DNA, 1989 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtgagttgcctgtcacctctccctttcctggccctcactccccccacccgcaaggcccactcatcatgatcaagaagtcataaaggaggtgattgaaaggactgttttttcttctagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataagaccagaatatcacaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgaggcactatgggtagcaagtaaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatct

SEQ ID NO: 340918 - DNA, 5544 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcgatcttcatagtacggtgcagtggccagattttagttaactgcaaaaataaatgtgctcttgttgtggaggatggaggaggggaagcaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggcgttaaaaggtaattaaagtaaaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgc

SEQ ID NO: 340919 - DNA, 3886 bp, Homo sapiens
  misc_feature (3)..(3): n is a, c, g, or t
  misc_feature (5)..(7): n is a, c, g, or t
  misc_feature (3245)..(3245): n is a, c, g, or t
  misc_feature (3824)..(3824): n is a, c, g, or t
  misc_feature (3844)..(3844): n is a, c, g, or t
  misc_feature (3878)..(3878): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggcaggagaatcactagaaccccggggggcggaggttgcggtgagcctagattgcatagttgcactncagcctgggccaccagagcgaaaatctgtctttaaaaaaaaaatcaagatgcttaactgaaacagaggtatagataaggacacttggccaacccacagagactaactttgtgaacaagctgaaattaaggccttaaaggagaaatataataaatctgtagaaaactacactgatgagaaggccaagtatgagagtaaaatccagatgtatgatgagcaggtgacaagccttgagaagaccaccaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtaagaaacaaggaccttcatctgaacccagtttgcaaaaagnaagcacaggaggccagccanaggaaccttagttcccaacttaagggccccccanaaatctaa

SEQ ID NO: 340920 - DNA, 2888 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggtaatctcattctactggtgaaagcatgccagtcaaagctttcttaactaatttattccctaattttattgagtatcgagtatcgtcaagatgagagttcagattcttggtaagtggataaataaaactgtcccagtgccagatcagaatgtcataataattattgtttttaaatgatgaaatacctgtgcccagttaggtggaggcagaggtgaggaacttaaagcaggaacacaggagaagatctagatgcctttctgcagatgtagaa

SEQ ID NO: 340921 - DNA, 1875 bp, Homo sapiens
  misc_feature (3)..(3): n is a, c, g, or t
  misc_feature (5)..(7): n is a, c, g, or t
ggnannnggccccgagactgcatcattccgcaccggctgctgcagggccagagggagcaggtggagcgagagagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtgggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataagaccagaatatcacaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgaggcactatgggtagcaagtaaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatct

SEQ ID NO: 340922 - DNA, 4245 bp, Homo sapiens
  misc_feature (522)..(522): n is a, c, g, or t
  misc_feature (591)..(591): n is a, c, g, or t
  misc_feature (2082)..(2082): n is a, c, g, or t
  misc_feature (2482)..(2482): n is a, c, g, or t
  misc_feature (2487)..(2487): n is a, c, g, or t
  misc_feature (2489)..(2489): n is a, c, g, or t
  misc_feature (2491)..(2491): n is a, c, g, or t
  misc_feature (2495)..(2495): n is a, c, g, or t
  misc_feature (2535)..(2535): n is a, c, g, or t
  misc_feature (2541)..(2541): n is a, c, g, or t
  misc_feature (2550)..(2550): n is a, c, g, or t
  misc_feature (2560)..(2561): n is a, c, g, or t
  misc_feature (2577)..(2577): n is a, c, g, or t
  misc_feature (2667)..(2667): n is a, c, g, or t
  misc_feature (2705)..(2705): n is a, c, g, or t
  misc_feature (2712)..(2712): n is a, c, g, or t
  misc_feature (2789)..(2789): n is a, c, g, or t
  misc_feature (2798)..(2798): n is a, c, g, or t
  misc_feature (2811)..(2811): n is a, c, g, or t
  misc_feature (2814)..(2815): n is a, c, g, or t
  misc_feature (2829)..(2829): n is a, c, g, or t
  misc_feature (2833)..(2833): n is a, c, g, or t
  misc_feature (2840)..(2840): n is a, c, g, or t
  misc_feature (2847)..(2847): n is a, c, g, or t
  misc_feature (2854)..(2854): n is a, c, g, or t
  misc_feature (2862)..(2862): n is a, c, g, or t
  misc_feature (2869)..(2869): n is a, c, g, or t
gttttgtaactcaactggcctgcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacngcccttgtgactccaaccagcctcacaagaacatcaacatcacctttgaggaagacaaagtcaactcanctctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaaaatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcctgctcattgaatcagcatctccaggccctcctcactccggatgagccagacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagaagtgctgttnactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcaggtgtgctgntggangngnaagngcctgaagtcttgcaggactcactggatagatgttattcnactccntcaaggttntcttgaactnnctgactcatgccagcnctacagaagtgtgtgttactcatttgaggaacagcacattcagcttcgcccttgacgtggacaatagggtttctttactttgatgggaanaaggtctccacctgagtcttccagatgggagtcatatncccacantaagcagcccttataagccgagagatgtcattcctgcaggcaggacctataggcacgtgaagatttgaatgaaactntagttccanttggaagcccagncannggatgggtcagtgngcanggctctnttcctantctcagnccatgccngtggcancctgtgctcagtctgaagacaatggacccaagttaggtgtgacacgttcacataactgtgcagcacatgccgggagtgatcagtcagacattttaatttgaaccacgtatctctgggtagctacaaagttcctcagggatttcattttgcaggcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacgcaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggagaccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctcaatgtttactgtgcctttgtttttgctagtttgtgttgttgaaaaaaaaaacattctctgcctgagttttaatttttgtccaaagttattttaatctatacaattaaaagcttttgcctctagatcgcgggcggccgc

SEQ ID NO: 340923 - DNA, 2874 bp, Homo sapiens
  misc_feature (711)..(711): n is a, c, g, or t
  misc_feature (1111)..(1111): n is a, c, g, or t
  misc_feature (1116)..(1116): n is a, c, g, or t
  misc_feature (1118)..(1118): n is a, c, g, or t
  misc_feature (1120)..(1120): n is a, c, g, or t
  misc_feature (1124)..(1124): n is a, c, g, or t
  misc_feature (1164)..(1164): n is a, c, g, or t
  misc_feature (1170)..(1170): n is a, c, g, or t
  misc_feature (1179)..(1179): n is a, c, g, or t
  misc_feature (1189)..(1190): n is a, c, g, or t
  misc_feature (1206)..(1206): n is a, c, g, or t
  misc_feature (1296)..(1296): n is a, c, g, or t
  misc_feature (1334)..(1334): n is a, c, g, or t
  misc_feature (1341)..(1341): n is a, c, g, or t
  misc_feature (1418)..(1418): n is a, c, g, or t
  misc_feature (1427)..(1427): n is a, c, g, or t
  misc_feature (1440)..(1440): n is a, c, g, or t
  misc_feature (1443)..(1444): n is a, c, g, or t
  misc_feature (1458)..(1458): n is a, c, g, or t
  misc_feature (1462)..(1462): n is a, c, g, or t
  misc_feature (1469)..(1469): n is a, c, g, or t
  misc_feature (1476)..(1476): n is a, c, g, or t
  misc_feature (1483)..(1483): n is a, c, g, or t
  misc_feature (1491)..(1491): n is a, c, g, or t
  misc_feature (1498)..(1498): n is a, c, g, or t
tgggaaatatctgaacgaacacttctgtatttacagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagaagtgctgttnactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcaggtgtgctgntggangngnaagngcctgaagtcttgcaggactcactggatagatgttattcnactccntcaaggttntcttgaactnnctgactcatgccagcnctacagaagtgtgtgttactcatttgaggaacagcacattcagcttcgcccttgacgtggacaatagggtttctttactttgatgggaanaaggtctccacctgagtcttccagatgggagtcatatncccacantaagcagcccttataagccgagagatgtcattcctgcaggcaggacctataggcacgtgaagatttgaatgaaactntagttccanttggaagcccagncannggatgggtcagtgngcanggctctnttcctantctcagnccatgccngtggcancctgtgctcagtctgaagacaatggacccaagttaggtgtgacacgttcacataactgtgcagcacatgccgggagtgatcagtcagacattttaatttgaaccacgtatctctgggtagctacaaagttcctcagggatttcattttgcaggcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacgcaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggagaccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctcaatgtttactgtgcctttgtttttgctagtttgtgttgttgaaaaaaaaaacattctctgcctgagttttaatttttgtccaaagttattttaatctatacaattaaaagcttttgcctctagatcgcgggcggccgc

SEQ ID NO: 340924 - DNA, 340 bp, Homo sapiens
acatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaagtaatggatggtaacatatgaagaatatctaggaggtacaccctctctggcatctatgatgggccaaaaacccgcatttgcttggccacagtatgtgaaatataacccagcttagac

SEQ ID NO: 340925 - DNA, 1002 bp, Homo sapiens
attgtccaagaccacacagagcccacattagagccgggtgtaagaatgcccctccctttaccccctcccctgctccaaatctcccacactttccactttacgaattgcttcctcttttccaaatggcaagaatgatgtctatgacgagttgctcaattgcttacgggaacaaggcacccccttcccccaagcatcagcctcccctaggctgtccctctccatagacagtggttgtaattgaaggggaggcagccattttccagccctgcctgcctactgtcactcaggcacatccctacccctctgggccccaggtttcccatctgtgtgtgaaggaaggatgacatctgtggttttcataatatcttcaaagcagggaaacccttcctttgaaggaaaccttcaataaaagcaacagatgaaaatgaaactgctggggttggcctggcccacacagcttctccctgcagaggcctgagggtcccactcagtagaaaactcctgggctcgttggtccctaaaggcctctctgctctgatttcctctggtgctaggtggatggagggacactaatattcttagagctgatgagagggtgtgtggaagtccccagtggcctagagttcaggctggcagggagcagggtgtcagggcaagtggtcagtgtgggagagaggacaggacacagtaggggagtcagagagctgagttcaaattcactggcttgcttacctgtcagtgtgtgagcttgggcaaggtactcaacctctgtaaatctatagaatgagttgataataactgcctggcagtgctgtcactaatatggtaacatagaaaatactgagctctttgcctggcatgcagttgaagattaatcattggtgtcaccagtattagggacaggaggcttccactgagcccaaggtcattgcctttctcttccccaccacacttgctgcacaccaagtcccagcagagaaaccacagctgggagcaggatct

SEQ ID NO: 340926 - DNA, 747 bp, Homo sapiens
tccacgactcttttcacagccagtaacagaaagcaacttcttttactaaactccaacattcaattaatgaagacctccaaagtacgctgagaacacacgtttgggtttgtgttcagtttgtgcaattaccaagcaggctaaactttagtccttgcctttgtacattattcacagaagagtgactaccatttataaaaacaagaatgagatagcactggggatttcacttctcaagaaggagagcatataagtatttcaaattcatacagagcacaggaaaatgctaatgtaatgacacgttaaattctttccatcaaaatcattctgcaagtcaccttctcaactctactttgtctcattcagggctagattttggtctacatgcacttcaatcaattcctgtctgcacatgccctggacagagtaggaagtaggcagtgtaaacaaaagatcactgtttcttgtgatcaaacaatgaaagggtttttattcactgctggcctcatctggagagcagcttcatgtgctgctgtccactgcagcccaccaccaggacatgcccaggtcacagttagccaagagcagtgttcctgcacatggagtgacttgagctggacaacctgactgtgaagaacctagaagccacagaaggtaaacaactccagcttcagtattaggggttatggaggggaaagagggaggcatgttggttgcagaatgagacttaacagcagggggtcctctaga

SEQ ID NO: 340927 - DNA, 659 bp, Homo sapiens
tccacgactcttttcacagccagtaacagaaagcaacttcttttactaaactccaacattcaattaatgaagacctccaaagtacgctgagaacacacgtttgggtttgtgttcagtttgtgcaattaccaagcaggctaaactttagtccttgcctttgtacattattcacagaagagtgactaccatttataaaaacaagaatgagatagcactggggatttcacttctcaagaaggagagcatataagtatttcaaattcatacagagcacaggaaaatgctaatgtaatgacacgttaaattctttccatcaaaatcattctgcaagtcaccttctcaactctactttgtctcattcagggctagattttggtctacatgcacttcaatcaattcctgtctgcacatgccctggacagagtaggaagtaggcagtgtaaacaaaagatcactgtttcttgtgatcaaacaatgaaagggtttttattcactgctggcctcatctggagagcagcttcatgtgctgctgtccactgcagcccaccaccaggacatgcccaggtcacagttagccaagagcagtgtcgctagaggatgtactagtctagagactcgggcaacagtgacgaccaagaacaaacgaatgcaagagtacg

SEQ ID NO: 340928 - DNA, 620 bp, Homo sapiens
tccacgactcttttcacagccagtaacagaaagcaacttcttttactaaactccaacattcaattaatgaagacctccaaagtacgctgagaacacacgtttgggtttgtgttcagtttgtgcaattaccaagcaggctaaactttagtccttgcctttgtacattattcacagaagagtgactaccatttataaaaacaagaatgagatagcactggggatttcacttctcaagaaggagagcatataagtatttcaaattcatacagagcacaggaaaatgctaatgtaatgacacgttaaattctttccatcaaaatcattctgcaagtcaccttctcaactctactttgtctcattcagggctagattttggtctacatgcacttcaatcaattcctgtctgcacatgccctggacagagtaggaagtaggcagtgtaaacaaaagatcactgtttcttgtgatcaaacaatgaaagggtttttattcactgctggcctcatctggagagcagcttcatgtgctgctgtccactgcagcccaccaccaggacatgcccagctgcaaaggttattcccaagcaaggagtaggcacacgagcggccattgagtagagc

SEQ ID NO: 340929 - DNA, 189 bp, Homo sapiens
atcctttagcagatatacggtttacaaatttttttcccattacttaggtagccctttcattttgttgatttttttccttctccatgcagaagctttttagtttgatgaaatcccacttgtctattttagctttcattccctgtatgttggtgtcataaccaataaatcattgctcaggccaatatcaag

SEQ ID NO: 340930 - DNA, 123 bp, Homo sapiens
agtttcttgatgtctaaggagccagtcttgaaagtgttagaccaaggttactgtcagagccaccatgttcttcttccttggcgtagagaaataatatctaggttctgtgcaggtcagcacatg

SEQ ID NO: 340931 - DNA, 236 bp, Homo sapiens
cttttcagtttcttccttgattgctgttgtcacaactttatccagctcctttttagactgttctgcttttaaattaagctgttcacactttatcttagcttcattaagtttctgttcaatcaaagccttatcttcctgtgacagcttttcaccattctcttttaagaagttctctgtgtttttcactacttcagccaatgcctgtgcacttccttgcatatctttctgtaattcct

SEQ ID NO: 340932 - DNA, 299 bp, Homo sapiens
tcatctgccgaaaggaagtgcttgctttatctgcaggaagcacattgatctgctgaactcataacaaccaagagttacaagctgttgctaaacctgcttacttgtgtagataacttaaaataccttcataaaagaacttcactaatattgttttggtttttgtccaaaacaagccatgagttataaaattccagtactgaaacatttaataataatctcctatgtaggtactatctttaagttcgtatctgtgtgtttttaataagagctttaataaaagcaaaccagtaatgaaacag

SEQ ID NO: 340933 - DNA, 417 bp, Homo sapiens
ccatctcttcagaagcctcattttctggttttaaaacgcttgaaagttgaattcgtaatcagaaaattgataggcaagtgtggtatctgaacagagaggctggaactattccatgcagatagagagagaatctccctcccttcctaacaccagtagggttctgacccaaccagatgttattagtcaacaaatatgtacagaacacccacggtatgccaggctccattctaggacctgggcatggtttttgcctttatgaagcttacattcttgttgggagagacatattgaacaagcaaacttaaaaaatgtgataaattcagataatgagaagtgctataaggaaaaataattaaaagtgacttagaatggggaacaccgctctaaggaggtagcacacaacctgaaccttttatc

SEQ ID NO: 340934 - DNA, 367 bp, Homo sapiens
aatataagtgaggtcagaaaggtaggtaggggccagatcacgcagcacttaataggccatgataaggattttaaaattgtacgtaacaggaagccatcgaaggggtggaggatttgataccttttaaagcagtatgtcagctactatgtgaagacaggagttaagggtggaagcagagattggtagcttaacctattaactgggcccgtggaggtgctatttattgaaatgggaactattgtaaggggaatatatttggaagcggggggagatcaagaactcccatttgaacttgttaaatttgacactgccagttagaatgactattaacaaaaagacaaaaaaataacaaatgctggtgaggaca

SEQ ID NO: 340935 - DNA, 250 bp, Homo sapiens
gatgcaggcaaggtagctgttactgcagtggtttctatgcttgcctttcaccagagagagcagttttatgattcatcattcatgccacacaaccctctctcctaatatataagtttgacaaaaggcagagcactttgggaactagcattcatcatgcttgtttgcacaaacctgatttatgtttacctatcctctgacctcccctgcccctctgttctctagattccagtaggaagctccacagtaacag

SEQ ID NO: 340936 - DNA, 578 bp, Homo sapiens
gccaaggcaggtggatcatgagttcaggagattgagaccatcctggctaacacactgaaaccccgtctctactaaaaatacaaaaacaaaatattcagaacatttacaaagctgcttagcaaaggaaattaatctcaatggttagctttcctcaattattgttttccccttttctccattttaacccttatttcagactttcatctatttcagactattcatgtagattgtcttagtcctttgcggctgctattatataacaaagcaccaaagactgtatcttataaacagcggtaatttctttctcatagttctggaggctggatgagggcagatcagggcactagcatgattctggtgagggctgttttccaggtagcagactaccaacttcttgttgtatgctcatgtggcagaaagagagctagagaaaattctatggggtccctatataaggccctgaatcccattcatgacctatttacctcccaaaggccctacttccttacaccagtcatattgacagttaggatttcaatatgaatttgggatcgcaggagatacaaacattcaagcta

SEQ ID NO: 340937 - DNA, 1355 bp, Homo sapiens
atgttctacagctgtgttcaatatggtagccactagctacagatggctctcaagcacttgaaatgtggtgaatgggaccgaagaactgaatttttattttagctattttttattcatttctatgtaaatagtcacatgtggccagggctgccattttattggacagtgcagctctaaagcagtggctataaatgtgagacctcccaacaatagattagcatcatctgaaatctggtcagaaattcaaattcttgggtgcaaatcaaaaacccttactgaatcaaacaccctgggggtgggagtccagcaatcagcattagagaagccctccagatgattctgatgctaaagtttgagagccactgtttgcaggaaagagtagagtggcaagcaagggggaagggcagagagactgaatggggatatagtggagagggtcaaggtaaggagtaaggagaatccagtgagaaggctgtaggagaccaatccaataaaaaaaaatctcttttccatcaattctgggaactgttgcttagactggagcccttctgcaaaagctgatggtcactttacttgcttggagatcccttgtggaattagcctagtggcataaaagaactttacaaaccttccaaggaaggcgagagcaaaacggcctcacaagagggagtgactcagctttgacttttgggcttagcaggtttctctgacttttgaacataggctgagtgatgtggcacatcactataactggggtttactccccttgttccatcctgcaatcaccagatcccctgagccctgcattcaaagctggtagtgacattagcttaaaaactgaaaacgatgttttaaacatcattaaaaacatcagtcccgctgcactgggggtttaatgtgagttgggagagaagctgctcatagttggagtagactattttaagagcccacttatgatacctcccgctatgcctctctatactacacaaatttcacaattggagaaatagaagcatagagaatttaagaagtttgagcccagctcacaaggtcactcagtagcagctctaaggggcgctgtctattaggccttctttagtctctaatgtatttaatctggcagctttttgaactctgagcatcattttctttagcttgcccagcaagctataaattaagcaaccgcacctcctaatgacttttaggatgttctcctattgtgccagaccccaagtgcacaattgctaaaccactctgttttgtaaatatggagaaccatagcaccctgtaagtcaggcactcctaaaatctatttttaatatcttagattattaaaaatagtttgaataaattcc

SEQ ID NO: 340938 - DNA, 654 bp, Homo sapiens
tttttggtattttcagtagagacagggcttcaccctgttggccaggctgttcttaaactcctgacctcaggtgatccgcctgcctcagccttccagagtgctgggattacaggcgtgagtcatcacgcctgaccctctaatcccaacttctaacttaccagcggtgtgaccctgtgcaagccgtgttatgtctctgtgcctcagtttgcttgtctgtaaggtgcaaaggctgcgagttgcaacttccgagggtcgaggtgaggggttagcagatcatcaggtggcacacagtgggcactgcggaagtgtgtgttgctgccactgttggcaggaatattgagcctgccccgtgcctcctcaggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccaggtaggagagaggggtctttaccatgccccccaaaaaccatcaccactaactgtggccccacttaccatcatggtcctcttcccaggagagagagggagtggggcagagcaaagcagaccccagtc

SEQ ID NO: 340939 - DNA, 3919 bp, Homo sapiens
gtgccgggttcgagtgaagtgactcggctgggctttgcaccgggtcttgctgtgtaccacaaacaccgcctgtctctgggatgacacggatgcgacagtttggctttgatcctaggattccacctgagcggaaacatccgcgagccagggagtcctggagagcccgagcgcctctaccatgtctccatcagctttgatcgctgcaagatcacgtccgtgagctgcggctgtgacaaccgcgacctcttcactcgaatgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcggccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgcaaaaaaa

SEQ ID NO: 340940 - DNA, 3247 bp, Homo sapiens
actggaatgacgcctacctgcagaggatcctggccagtgactcctacgggcccagcctcacaggcagcgtgggtggggacaaaccgactttcgacccccagggccgcccactgtggctgggagaacctttccccactgcctgtgcccgtgtggacaccctgcgtgcccacggatacccccgccaggccctgcggctggcaagtgccatcatcaacacactccggctgcagcagcggcatcagctagagagctacaagcagcagaaaaaagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcggccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgcaaaaaaa

SEQ ID NO: 340941 - DNA, 3600 bp, Homo sapiens
gtgccgggttcgagtgaagtgactcggctgggctttgcaccgggtcttgctgtgtaccacaaacaccgcctgtctctgggatgacacggatgcgacagtttggctttgatcctaggattccacctgagcggaaacatccgcgagccagggagtcctggagagcccgagcgcctctaccatgtctccatcagctttgatcgctgcaagatcacgtccgtgagctgcggctgtgacaaccgcgacctcttcactcgaatgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcggccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggtctatccagtttttggacaagattaaaagcaattcttaactggtcataattttttttaaaggtaataagaacactatggtttatacaatattgaaaaaatacaattttttatggttggaactcaaatcaccacccagcactttaagccctccctaagacccta

SEQ ID NO: 340942 - DNA, 458 bp, Homo sapiens
ggccagtttttttgtaaagatgggagcctctctatgttgcccaggctggtctcgaactcttggcctcaagcgatcctccctcctaagcttcccaaagcgctgggattacatcaaccccaggctcctaacccactggcccttcctacaggtggaggagcggttctcccgggtgcctgagcccgtccagaagcgcatcgtgttttggtcgtttccacgcagtgaacgggaaatatgtatgtactcgtcgctgggttacccgcccccagagggcgagcacgatgcccgggtgccctttacccgcgggctgcacctgctccagagcggggccgtggaccgcgtgttgcaagtgggtgagtctttgtcccccactcctgctggggaggccaggaggtccataccaggcctggaaatgggggagttggagggaggcctggggccaggggatgggaggttacaga

SEQ ID NO: 340943 - DNA, 4348 bp, Homo sapiens
taaaggggccgcatcaccctgccggcccggcgcgggtcgggggtgggtgcggtaggggtcccggggcggccgagcgcagaggacggacgggaaggagggcagggggcgcgggagccggcgaagcggagcgggcatcggaccgagccccccaaagaggccccgccccggccctggccccggccgggccggatggaaccccccgcggccaagcggagccggggctgccccgcgggacccgaggagcgcgatgccggggccggggccgcgcgtggccggggccggcccgaggcgctgctggacctcagcgccaagcgggtagccgagagctgggccttcgagcaggtggaggagcggttctcccgggtgcctgagcccgtccagaagcgcatcgtgttttggtcgtttccacgcagtgaacgggaaatatgtatgtactcgtcgctgggttacccgcccccagagggcgagcacgatgcccgggtgccctttacccgcgggctgcacctgctccagagcggggccgtggaccgcgtgttgcaagtgggattccacctgagcggaaacatccgcgagccagggagtcctggagagcccgagcgcctctaccatgtctccatcagctttgatcgctgcaagatcacgtccgtgagctgcggctgtgacaaccgcgacctcttcactcgaatgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcggccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgcaaaaaaa

SEQ ID NO: 340944 - DNA, 3506 bp, Homo sapiens
tttttggtattttcagtagagacagggcttcaccctgttggccaggctgttcttaaactcctgacctcaggtgatccgcctgcctcagccttccagagtgctgggattacaggcgtgagtcatcacgcctgaccctctaatcccaacttctaacttaccagcggtgtgaccctgtgcaagccgtgttatgtctctgtgcctcagtttgcttgtctgtaaggtgcaaaggctgcgagttgcaacttccgagggtcgaggtgaggggttagcagatcatcaggtggcacacagtgggcactgcggaagtgtgtgttgctgccactgttggcaggaatattgagcctgccccgtgcctcctcaggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcggccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgcaaaaaaa

SEQ ID NO: 340945 - DNA, 1812 bp, Homo sapiens
gtgccgggttcgagtgaagtgactcggctgggctttgcaccgggtcttgctgtgtaccacaaacaccgcctgtctctgggatgacacggatgcgacagtttggctttgatcctaggattccacctgagcggaaacatccgcgagccagggagtcctggagagcccgagcgcctctaccatgtctccatcagctttgatcgctgcaagatcacgtccgtgagctgcggctgtgacaaccgcgacctcttcactcgaatgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctggatg

SEQ ID NO: 340946 - DNA, 309 bp, Homo sapiens
gtgaagaataataaaagattttatttttgaaacatcttgcatagttgccctggttggagtgcagcagcacgatcatagctccctgtagcctagaactcctggctcaagtgatcctctgcctcaatgtccagcatagctgagacaacagtttggaactatcacacctggctaaatgtttttaatgcttcaagttttttgtataaatggggtctcactatgttgacaaggctggtatcaaattcctggcctcaagcaattctatctcctcagccaatcaatatgccaggaatacaggcatgagacaccgtg

SEQ ID NO: 340947 - DNA, 2830 bp, Homo sapiens
  misc_feature (22)..(22): n is a, c, g, or t
tggtacggtcccaagcccttanatcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctca

SEQ ID NO: 340948 - DNA, 2786 bp, Homo sapiens
ggtattacaggtgtgagccactgtacccagtccactaatatttaatctcaggattgacttcacaccatcactcagcaacatagggcagggggccatgtagtcatggaatttctaaggtatcctggggaaggatgggcagaggcccccgtcggacttgttggtttgcttttagcacgtgactgcattttgcagtttccatgtgctaggtggagtggatttccagattactctttttttaaattttatgttagtaagtacttaagttagttatttcaagtgaataagcccctggctttctcaggacgtgaccctcactcttccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctca

SEQ ID NO: 340949 - DNA, 1899 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccaaaaaaaaaaaaaacgaaaaaaaaataaccaaaaaagggggggggggcggcaaaaaagttcccccagggggggcccaggtttagggtcacccggtttttcttgtccaacaaggggggggccccccataaaagagagagccgcgtataataaagcagcagagcgaaggaggccagcgagattatataaacaacgggcgcggagaacgggcgagaaaccaggttcccgatctcggtgcacaaaactcttgggtggaagaaaagaaaaaccccccctaaacttacggccggggggggggggggccaacacatatttgtggcggcacaaacatcaatcctctacacaaaggaatatattaaacacgcccaccagcgcggggaacaaaaatattacatacactgttcacgagggggtgaaatacgagtgtggtttgtaaaacacacatgacgagccacgaaatatgaccttgagccgggtttaaaaagatttgctccaacaaggagagacttatatcttgggacaatatttttacc

SEQ ID NO: 340950 - DNA, 696 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggaccgtagggcgcacggtccactgcagagcaggtgaagggcgtacaggtaccatcgtcgtaatcgatgccatgctggaccatgaagcactacagaacaggaaggtaggacgtgtactaggctgatgtgagccggatccgggcacagcgaggtccagatggtgcaaaccgatatgcagatgtcttcatataccaaacgctttatggagcatgatctctatg

SEQ ID NO: 340951 - DNA, 2883 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctca

SEQ ID NO: 340952 - DNA, 3021 bp, Homo sapiens
ccttacctttgacatgacgtatgctaagggattaagaagaagagctaactgtcctcaaatatatatgcacccaattacaggagcagccagattcataaagcaagttcttagagacctacgaagagacactttcacacaataatagtgggagactttaacaccctactgtcaatattagacagatcaatgagacagaaaattaataaggatattcaggacttgaactcagctctgcaccaagcagacctaatagacatctatggaactcttcaccccaaatcaacaggattgacttcacaccatcactcagcaacatagggcagggggccatgtagtcatggaatttctaaggtatcctggggaaggatgggcagaggcccccgtcggacttgttggtttgcttttagcacgtgactgcattttgcagtttccatgtgctaggtggagtggatttccagattactctttttttaaattttatgttagtaagtacttaagttagttatttcaagtgaataagcccctggctttctcaggacgtgaccctcactcttccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctca

SEQ ID NO: 340953 - DNA, 2457 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctca

SEQ ID NO: 340954 - DNA, 889 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggagtggacttgctgaggttgaggtagtagtcgtcgcaacacaa

SEQ ID NO: 340955 - DNA, 573 bp, Homo sapiens
tggctagggtacgaggctggcgtaatcggcacgagggcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccaggtaagactcgggtcatcgcttgtgaccttttctccttcagccggtcatgactgcatttgggcaggagaaaaaaagattttgcttcgaaggcatctttgctcagtcatggaccgttctttcgcttcatgattgttgcagtatcattgaacatca

SEQ ID NO: 340956 - DNA, 452 bp, Homo sapiens
cgcagtggctcacgcctgtaatcctagcactttgggaggccgaggcgggcagatcacctgagggtgggagtttgagaccagcctgaccaacatggtgaaaccccatctctactaaagatacaaaattagccgagcatggtggcgcacgcctgtaatctcagctacttgggaggctgaggcaggagaatcacttgaactccagcctgggcaacaagagcaaaactccgtctcaaaaaaataaataaattcaatctcaatcacagcaacatctagactggtatttgaccaaatatctgggttgtgtggcctagccacaatgacacataaaattaaccagcacagataacaagatcacactacttcatggtgtatttacttgttcccctggacagagcctagggacatgtgccttatatggctgttgtgcaagttttgctactgggactttggtt

SEQ ID NO: 340957 - DNA, 456 bp, Homo sapiens
tgtgtgagaactgcaggtatagcacctaggaggtcatcttagaaatctactggagcaagagaaagaacagagaaaaggggaagtccccattaccctccgagcaaagaagcttccttgctactgaatgtggctagagctgtaccccacccactctgtctgcactactgtgcagttgttccaaggtggttgtctgatttgactgtgaagagcctggatagttaacatgtgttgggtctgggtggtgatacatcagtgtgtgttatctcactctatatagccttactttggaagtatttcatggtgataatagacaaagctagtgggttttgtgtgaagagagtctgttcataggaaaacatgatctgttcatcagtctagcttggcagctagctaaataaaccacgtgtaactcaatggctcatagagctttattattaccatagagatttatgttac

SEQ ID NO: 340958 - DNA, 660 bp, Homo sapiens
agctttctaaacaacttagttgcacatcctactttagagaaaagacaagtgttaagtgatggtgacttgaaaactgtaaagtttattgtttggaaaaccgcatgagaaaaatggccagaacatatttgtgctaaaaagagttaacatagcaggccttaagactgctatccttagaaaggactgcttgcaatgttggtgcttgtttggcatctgggaacttagatttttgggtttgtgctgaacagtatgttttatgccgaaattaccagcttctgtaaaaatccgggacaccaagtctttaatgggcttccctgcgcggaaactgctgcattttcactgatggaggaaggatgtgttttgtttgacccctcttgggagggagaccgcataaggagcctacacgtgattcctccagactccgcttgtgtctttttctattatgatgagcctttatatccatactgcattgtgtaataaatgtcagccatgaattcaactatatgttgagtcccgtgcatcctatcaaagctctaaatgtgggggagatcacggagatcctcagccacagttttgtaaatttgtataaaggtaagggatataagtgccgtttttttacgaggatatatttcctagtggtactgggcttttagtgtaaccatc

SEQ ID NO: 340959 - DNA, 986 bp, Homo sapiens
gagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggcagtggatgcgtgcccgctggacctctgacccctgctacgccttctttggggtggacggcaccgagtgctccttcctcatcttacctcagtgaggtcgagtggttctgccccccgctgccctggaggaaccagacggctgccagagggcaccc

SEQ ID NO: 340960 - DNA, 370 bp, Homo sapiens
cctctggagtaaaaccagctttttgaatctgataataaaacaaaagctgttttttcctgctctctactaatagaaagtctttattaactttaccttactggttttgttagtacagtgactagtgactggtagtaaatgataacctagtggtaatgggagatcctgaagtctcctgaatcatcaatgacaggtcacattgggttcagtgcagctttagccttttgagtatgttttattgtaaggagttccaaacgccagccactccttgaaagatgaggtacctggtgatttgctgctgagtcactgaccgagatattctttaaaaatgcagatttcccagccccacttcctggagattttgactgagtgg

SEQ ID NO: 340961 - DNA, 291 bp, Homo sapiens
ctgggaaaaatacacatgcaggagtgttgtcgaaaacaatacctaactggacagcaaacagggaaggccaacattatacctagattgagataatggctgggggcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggca

SEQ ID NO: 340962 - DNA, 335 bp, Homo sapiens
tccactggcagaggtagggaaggaaagtgctggcccataaaatgtttagattagttgcatttgctaatcagtctgatcttcccatgccaggccctaaaggagccacagtctgaattctttttcttgaactcttgtctgaaatgaaacacagtatcttcagacaaattagagcattctgaaaacacctttggacacagtagtcctagctttcttcctcttctctaaagtactcaaggttaggaagccagaagtttgccactcagggaaagaagtagcctttgtttgaccctctatgctcacagcagaactggtagatctggatagaggtagcaagt

SEQ ID NO: 340963 - DNA, 246 bp, Homo sapiens
tagatgcccctcctcctcctgtaaagggaagtgggattctcatggcaatgggtctttgtctcatggtcttttccttgtggctccctatatcctgcaggacagccccaggttcctgtcccactctgccatgactttgggtgaggcccctcctttcttgccacctcagtttgcagacccagagtatgggagcagattgccaaggaagttgtcagctctaactgccaccctagctgtttgaatgtccct

SEQ ID NO: 340964 - DNA, 771 bp, Homo sapiens
ctcatgattcagagtgagataaaggcaaggagtcattggcaacagaagccagaaagctttcccctgaggctctctctgaggatcttggatttgcttctggaagcttagctctggagaagagcagcattcaggacaagcgaacaggtctggaacttgcttgggctagtcgcttcacttgagtgctttagtttcctcatctgtaaaatgggttaatcacagtaagtaacatataaagtggtgagaattaaagcattactatgtggaaagcatatagatcaatgtttattgaataatgtgtgtatatactctgtgttttcatttaattttctgccgtgtgtactttcctgtcattaaaatagtctttagaaacacggttttagggactgtacaaagtctttgcttcctgaattttgaacttggagaacagaagataaggaagggccaagtgagaaagagaagatgaaacaaaatacctgatgcttcttgtttgttgtaggaaataatgaggaaagaaaatagtcctcagactcacagcaggaaacagaggactagaccatgaccttgagatccaggcagccagctgactgaggggtgtgtgcactcaggtgtatgccacacaccctccacatacacacacatgtgttctttgtcttagggaggaacaaggaacatttttgtcttggcattggattaagtttctatttctcaaaaatcatttcataaatataaaaacaccaaagctacagattgttgcctgttgctgcagttgat

SEQ ID NO: 340965 - DNA, 192 bp, Homo sapiens
cactcttctgattttcctagtagttgcttctttacatttctttatagttccttcaccccatcatacatttctagacactaaataatttggttttggtaatgtttttagactgtgtcttttaagtctcctaatctgtaggtatcactccagctatttaatgttgtttctcagtctgcgctctgctggtgtaat

SEQ ID NO: 340966 - DNA, 351 bp, Homo sapiens
gaggcagaggttgcggtgagctgagatcgtgccactgtactccagcctgggtgacagagcgagactgactcaaaaaaacataaaaaatttggagagtagaagaaaaaaaagtttctcatggtgggtatctaaagtaatcactacacattttgctctgtgtcttttagctttgtttcctccttaagcttaggttttaaaaatatgtagttataattgtataaataattcaaatattgattttttaaacttatgctaacatggatataatttcctgtgattagtatttatacagtaattaaaaatgcttgcataatagtacatcaaggtgatttttcacctttgtttatttaa

SEQ ID NO: 340967 - DNA, 477 bp, Homo sapiens
ggctataggtatggttgggaggagtggggcaggcaattaccatcatgcattataagcatatttgtttctttgagttttttaaactttttttttcttatagagacagggtcttgctatgtctcccaagctggtctcaaactcctgagctcaagtgatcctactgcctcgtactcccaaaatgctgggattacacgtgtgagccaccgcccacacttagcctaaactttgataaaaaataaataaatatgagtagaacactactcatcatgtcctgttctggggacatgccacttagcttttccaaggctctggggccacccaaactcctccctgcaagtcaggtcagctggaaattgtgctttgttgtgtggttctcattcagagagcttagccagggttggtttgagactggtccatcagctccttccttcagctgttttttttttttttctgagtcagagacttaaatgagtcttt

SEQ ID NO: 340968 - DNA, 281 bp, Homo sapiens
cacagggctgtccctctgtgtgtgtgtctgtcctcatctgctcttcttacaaggacaccggtccaatcagggcccaccctagcgacctcattttaccctaatcacctctgtgaggacctcatctccaacgcagtccccttctgcagtgctgggggttggggctttgacaggtgaatccgggggaggcacgcccacctgaacgctcagcccataacaagtgcagtctctcttttcctcgctgtctttctgcaatacatacgaatgacttatgtaacgctgaa

SEQ ID NO: 340969 - DNA, 954 bp, Homo sapiens
  misc_feature (4)..(5): n is a, c, g, or t
cctnncccaagtagctgggaccacaggcacgtcccaccacgcccggctaattttttgtatttttagtagagatgggatttcaccgtgttagccagcatggtctctatctcttgaccttgtgatctgcccacctcggcctcccaaagtgctgggactactggcgtgagccatcgcgcccggcccattctttaagctccacctaaaacatcacatcacttgtgaaccaatgtaatgtcaacagccctgtgtgcatatctgttataacaccccactgagttctgtgacacatcatgtgctcatctccctgggtccctcggaggccccatgctaaaggctacgcctgctgatccatgtgtcccacctcatgatgggcccagcgagcacatgggggcatctaggaagtgctgacggggtgaggaagcatgtgaacacatacctgtgtgcctgctctcactgagtcacagagatgtgcacatgaaagcacttccaattcattagcactgccatatcttcaaatgcagcttaaacagcaaagtatatttgtttcacaagaaaaaaaatttctgatgttcttaggaactttacaacacaaatatatactaaatttctgcttacttttgggactatgagtatttagatttaaggggtgtcgaggtatttcttttttgagacggagtttcactcttgtcgcccacgctggagtgcaatggcacgatctcggctcactgcaacctccacctcccgggttcaagcaaatcccctgccttagcctcccgagtagctgtgactacaggtacctgccaccacacctggccaatttttgtatttttagtaaagacagcgtttcaccatgctggccaggctggtctcgaactcctgacctcaggtgatccacctgacttggcctcccaaagtggctgggattacaggtgtgggccaccgcgcccggccagg

SEQ ID NO: 340970 - DNA, 622 bp, Homo sapiens
gcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactct

SEQ ID NO: 340971 - DNA, 131 bp, Homo sapiens
ccccctcccagacacagtgagcccccacaggaaggtagacaccttcctcatcccttctccactcttactaaagaatggtttggtcacctttgctctgctgagacctgcccagaggggttaagtatcttcaa

SEQ ID NO: 340972 - DNA, 116 bp, Homo sapiens
ctgagtgttaatttttcttcttttctctaattcccattttccccctcatgtctttctctataatgtaaaaaacaaaaacaccaccaaaacccctcctgtaacattttttttttttt

SEQ ID NO: 340973 - DNA, 418 bp, Homo sapiens
cacaacattcacacctcaaggaatgtattatacagttggtgacttagattatacaaacataaaatgatttggggtaattaaatcctaaggttgatagtgctctttataagtaaaataagagctcagagaagtgaaaagtaagggtggaatgaagtttccgagaggaaatatgtggcagagatggaccagctgttcatcaaacctgtttcttcttcttcctgggcaaacacctagaccaccttcccagcaatcccccttgcagtcagatgtggccaccttaccaagttctagctaatggaaagggaaaaaaaaacaaattgagccacatctgggcctagccaataaaaaccagccactcatgagcctccacatgcttttccttttttgctattatgatccaaataagcactgtgacctt

SEQ ID NO: 340974 - DNA, 477 bp, Homo sapiens
cagtgcatccatcagggtcagctgatgcccgtaggatctgaagttagtgatcatttttaggtcctcactctttcagagagcaggtcctgtgccacacaagaggaggcatgagggtcacaggcatgggaacatattatgagcctatgaagccccctgacccccctgccaaccccactgcagcaaagcccttcgctcgccctccccactcccttggtccttgctcatacacctattttggtgacacccatgctggctgccttgcacctgcggagggcccggctcacctccagcgtatgcattccttctcttcgttgtctattttagcttcctatttccaggatatagcggagcatttgactcctcacaaacattcagaatcattactcaatgaatggatggatgaatgagcaatgttgaaggaaaaaaggtggggggcattgggttaagagacaaaagatattcaaactagtcctaatt

SEQ ID NO: 340975 - DNA, 577 bp, Homo sapiens
aggcaaagtgggactgacccgccatccttctgcgcagctcctgggtgactactgaagctgatgtctacttagtagaggtctgggagattgtatggggcctggctgggacttctggtcagcgagcagacctttgaagaattggcttcttcaaacctgtggcccattcccaacagtgaggctgctgggagctggctacgtgctgtgggtccaggcagttcaagaggccttcctagaatatatgagaactctgcaaattttccttcagcctggggagcggtgagaaaggatgaagtgtaacagggccctgaaacctcatcccaactcgctattaagcaagggtgctcttttctaatctaatagagtaaaactgagaaaggggtcttctctacttcccaattccagggccttcctgcattcgctggtgatgatggagtagggtgaccttaggaggtgtgacttgggccctacaggctgtctgggaaagtcagagcttccctccatactcctcccagaacactgagtgggtggctgtgttgtgagagtcccttgagagcccagaggcagaaacgaactcttt

SEQ ID NO: 340976 - DNA, 504 bp, Homo sapiens
gcatcatctcagtcaattaaaaagaatgatccagatatacatcatccagcattattaagaagccaacacatctaggctctaggtcagacatgtcttagcagccaatattgtatcagacaaaccaccatttcacatacatccatttgcacatttaaaaatgagagcacagttaacatcatgctggattgttaccacagtcccatatctacctttcagagaatcaaacagtatgacacacataaaattcctttgtaaatcagctctattaagagtgaactaacttacttctaactgggaaaaagagcttgcagtatggacacaagaaaccaggcaggaaagaaagggaggtgggggtaggatcttgcaatgaagaacaaacccagctatgttcagcttgctatgccacttctatgggccacaggaaagtttcacaataagagataaataaacaattcaattttttccactttatagcacaactgaaagcaaaaccaatacagccct

SEQ ID NO: 340977 - DNA, 500 bp, Homo sapiens
tacagattcttatttttctctctctaaaagatgtgtacccctgaatatttctctgacatctcaaatttaaaatatctgaatctaacccattatcttttctaccatctcccgagtctgttcttcctcctgtgttggttctcaaggttaatacctccatgactcacgctgtcacctgtcatggaaggctcagagtcacctgtgattactccgttttcctcatcactcacatggagtccatgaccaaatcctcagagttctgcttgtgaagtgagtttcccatctttcccagccttatctctaccctaaccactgtgttaattcattcctcttcagctctttcccaggccatttgaataacattctagttatcatttgatctgaagtctctgtcctgctccctcaattctacttcaattaacttcccacttctattgccagagttaaatatatttctgacaacattatttccatccttaaaacattgaatggttcccaattac

SEQ ID NO: 340978 - DNA, 236 bp, Homo sapiens
tcagtgttgctgaactgaaatccaggtgtctgcagggtcgtgcttccccacaggctctgggagaaaacccatttcttgcctcttccagccagtggtggtttctggaattccttggcatgtggctacatcactccaatctctgcttccccttttgacgttgccttctttttttttaagacggagtctcgctctgttgaccaggctggagtacgtgatctcggttcactgcaacctct

SEQ ID NO: 340979 - DNA, 416 bp, Homo sapiens
ctctgcctcccaggttcacgccattctcctgtctcagcctcccgagtagctaggactacagacgcccgccacaacgcccggctaattttttttgtatttttagtagagacggggtttcatcatgttagccaggatggtctcgatctcctgaccttgtgatccacccacctcggcctcccaaagtgctgggattacaggagtgagccaccgcgcccggcccctccatgatctcatgcctacagcctggcctcctgccttgctgaccgcacctgccggctccctccaccaagttcattccaccaaagagtggaaggacacagctgctgtgtcctctgcctgggactctcttccttccctgagtcacctggttcagccagttcatttaggcctatgcccagatgtcaccttttcaggtg

SEQ ID NO: 340980 - DNA, 366 bp, Homo sapiens
tttcataaagatagggtgaaaaaaagaaggaagaaataatcaaaggtacaatggaagaaaagtaccttaagctaaataaaggcagttgtttccagattgtacagaatcatcaagtgctgagaagaatacattttaacagagccatatctggaggaatttcagaagtgaaaagataaagatcctaataaacatatgaatagggaaaaaagttatctaaaaaagacagaatcagactggcatcagatatctatctcataagcaatcctagatgaagggtaacaacgtaccaatgtttcccaagctctgagagaaaattactttgaatttatggttctaatcacaataatttatgaatgtactataagg

SEQ ID NO: 340981 - DNA, 514 bp, Homo sapiens
catacagtctagttaaggtgggcaggagttacacacatggagttaaatcatccatggcaacaagacacatgacacccaaaacagcagtgtctgatgactagcagatgctgtccgttccatcattccacagatggacaaagttgccatgagttggaatgctcaaggaggaaacaatagacagaataactgttgggtagggtctcggaatatgagccagagtcggctcatggccagtgattgggagaggagagcgtgcccagtgacagaggcaggaatgagcatctgcgaagggacagttaggagaccagtctagctggaataaggggtttgtgtagcacagtactgagaaaggaagacagaggcaggcttgtggagggtcttgactgccaggctaaggaaattggaattcaaagaggagtcagggagatttctgagtggaaggattgcatcgtaaaagcagcgtttgagaaacactagctaatggtagtgagtagaatgcattggttgtgttgta

SEQ ID NO: 340982 - DNA, 389 bp, Homo sapiens
cctcctccatcaatcacagcccacagtgtagtaagagcggaaggagcttggaggtcatctgacagggaccggcagtcctattgatgctggactacaaaagaaagttttggcacaattcaaccttgcaaaagaaggcatgaaggcgtcacttctctgtggtagaggggtggaaactccctgagtgtagctggtctgtttgatttctgaccaccactgagatctggacccaggccatctacctcgtgattcttgctactttatatcctcactgatgtcatcaccttctgaatagagggaaaccagccaagcaacttggacttttggcaggagactatttctaagtactcagtgcctcgtgcagtcctgggcatacagtggatacaaaaaaa

SEQ ID NO: 340983 - DNA, 237 bp, Homo sapiens
cagaatttccaacaaacaccaggagtaactttcaagtggaaacacagctggcacgggcagcacagggcttataaatgacggggcaataaagtggaattatgacctttgcacctgtcctttgcttctgtgcctttctcctctgcagccaccctgggctgtctctggcctggcctccttttacaatggagctgggggtaggacagtctattagaccaagcctcacaaagcagggaagca

SEQ ID NO: 340984 - DNA, 546 bp, Homo sapiens
acacacgattctacacaaggtctttcaagggcatctgtgaagttatgaatgctctgcaattttgaatatcatctctactataaacaggttggttttggttttcttttttgcttcaaaagcacggctacattaaaataaaagatttaaaaatagattttttaatatacacctactatgtactcacaaaaatttaaaaaaaaatttgttcttaagatttttttcccatcatgccagtgggaagagaaacagtgagtagccacttactcaagtcacctccttgagaagagcaagccaccaacagcccaatagcttcacgcctctcacagccctggggtgctgccctagggaagtgcctctcctcagatccctatcagtgctgcaatcagaaagcagtttggggcaggggtcgctggttcctcactcaagatccctagaaagctgcttccatgcacatgtccccaggcagaatcgggcgctctctgcactgtctgccacatgggggccacgggcgtctgtgaagaccagagactcgcctccccgatgagg

SEQ ID NO: 340985 - DNA, 196 bp, Homo sapiens
tgtgaagtatgcaggtgtgtgtgacgtgggtgtaagagtgtgtgtgcaaatgcatgagtggctgagtctgcatgagtgttatgagaaaatgtgtgtaagagaccacgtgagagtgagtgttcatacatgtgtctgcaagtgtgtgggtgtgaaaaagtgccggagactgggagcacatgagagtttgactgtgtgc

SEQ ID NO: 340986 - DNA, 892 bp, Homo sapiens
agtttcaaaactgctgagcaaaagaaaccagggtctgcttcgtatccatgatgtctggaacaggaaaaagcagcccatgtgatggaagccgactgctgggggctgggggctgactcggcagggcctgaggggctttctgggaggagagtggatgtgctcctgatttggatgagggtactggctgcataggtacatatatgtgccaaaactcatagaactgtacatgcaaagagggtacatttattaaatagacatcatctctcaataaaattgatttaaaaaaattaaacccacagggcattgatctgctttgaatttggaggtctaaggattaggggaccggattaccctacaagacagcctgaacacatatcagagccagatgtgaaggcactgcctgtccctgaagacctggggctctaagtcattcacgtgcggggccggcgctccgcattcaatcttccggcataccactcccctcggatgtcttctgagacaaggacagcccacgtccaccaaccccactgcaggcaaaccggcgcctgcctgatggaggacagtaaaggaaggaaaagttatctaacaaatttcaaatgtgtctgtgtacaccagcatgccaaatgtcagaagaaattctagggcagtttgtggactggtttcctgcgaagctagagcttttacttaacgccttaaaacccacaacaagccaaaagggctctcgtgtctacaaagagcaggcacacttggcacagaacacctggctaaacacagaacattaagaaaacaaaaaacacaggtctggccccagctactcaggaggctgaggcagggctatcactgagccgaagaggtcaaggttacagcaagccatcatcacgccactgccctccag

SEQ ID NO: 340987 - DNA, 153 bp, Homo sapiens
tctgttagctacaaaaaagatttaaaaaatcagtgaacataggaaggaagatttaaattctgcacacaattttaaaataatcccaacttccatttattagttttagtttttccctatcagtaatataagccattaaattagataaattctaag

SEQ ID NO: 340988 - DNA, 404 bp, Homo sapiens
aggccaaagtgggaggattgcttgagcctaggagtttgagcccagcctggacaacatagcaagacctcgtctctacaaataaaataaaacccaaacttcctaacaatggggcttagcaaacttttttctatagagggccagatagtaaatacattacactttgtggaccttacagtctttgtagcagttgaagacctctgcccttctagcactgaggcagccatagacaatatgaaaacaaatggacgtggctgttttccaataaaactttattcataaagacaggcagcgggccagatttggcccacagacagtaattcggtgaacactggtctacaaaacaactgaatggggaggaccctgcctccctcaccagccaccagtctcattctgacccactcctc

SEQ ID NO: 340989 - DNA, 447 bp, Homo sapiens
cacttaagactgtttcctaatcgtctgcctgctcctctattcaccctgcatacgctgtgacagatcaatcttctccgagcacaattctgctcacttcatttacttgctcaaaatctttaataaagtccatatttctcagcctggcattcaaatactcttcccaatttatactcaactgacacttattccaccttatttcccactagtctctgccaaacacctaaagcttcaatcaagtagaaacctatgcttttatcccgaggcattttgatccttctcatcacttcaactttgtattgagaactgacgttcttaactcttcccactaccatctatgcttactcgaattctaattaccattaatacaaggcccagatcaatgctgtattcaccaagacgcctcagcttctctctcctcagaactgccataatacaattgtacctagt

SEQ ID NO: 340990 - DNA, 200 bp, Homo sapiens
ggaccgcataactatacagcataaactatcacagcataaactattacagcataaactataacagcataaagaatattcaaaatgttcaggacacaatccaaaatgacttgacatacaaggaactaggaatacattaaacaaccctaaggaggaaaagcaatcaagaaagccaaccacaagactgctcagatgctgaaata

SEQ ID NO: 340991 - DNA, 709 bp, Homo sapiens
taaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttg

SEQ ID NO: 340992 - DNA, 493 bp, Homo sapiens
actctcagtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgaggtgaggcgcctccagcccccgcgcccagcccctgaggctcccgagggcctggcagccggccttgggtgaagccgcactcggggagagaacccagggacccacgcgcttccccggggactgggtccccttcaccagtcggatccccgcgaccacctggggcgcggagcgggcctcatccattctcttccttggctaagccgggagtgtggataagaacctagggttcctcccggggtttggactctgaatcaccggccaggtctcccaccctggaccgaaggggtcggaactggcccctcccacctaactcccacacacgcactcactccaaccgctgg

SEQ ID NO: 340993 - DNA, 682 bp, Homo sapiens
actctcagtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgagacgccacccccaccgaggagccaatggcgactgcactgggcctggaaagacggtccgtgtacaccggccagccctcaccagccctggaggactgggaagaggccagcgagtggacgtcctggttcaacgtggaccaccccggaggcgacggcgacttcgagagcctggctgccatccgcttctactacgggccagcgcgcgtgtgcccgcgaccgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtcca

SEQ ID NO: 340994 - DNA, 539 bp, Homo sapiens
gagattttggagatgtacaggtagaagtcaggggatggtgaagacaactgaaagttctttccagcctgagaatttcctggtgaaatcaaggtcaaaggactgtgtgtgtgaggggtcagcaagggcatttggtgaacagaaagctgcagtaagcagagaagacagtgatgtcatcacaaagttactaaaaacgtgtcacgtcactgggtgtttcctgcaggcatttcccagcagagacgaaataaaaaagtcataggagtgggaagtaataaatgggcatcatggatgtcgctcatgagtctcgctgaagaaggtggcaggctggtgtggaactgtttgtgcgagcacaagagttcatgtcctgaaaagcacaaacagccttcaccgcttgcatctactcacttgctgccctcacagtcaagttgtttggtgttgctgtcttcacctcctcactgtcgtcattcctcagccagccgccttgtttctcatcactcctttaaagcctctctctccaaagtcacctgagatctccagccatg

SEQ ID NO: 340995 - DNA, 545 bp, Homo sapiens
gcgtgagccaccgtgcccggcccaggcattttgaaatacttcagaatgtgtttcaggctgacatcactgaaactcagaaaaatacttattactcctgtagttacaacatgggaaaggcattgctaagaaagcatcaccataaataaacccgtgggattcagaaggtggggagttgggtgatgtgttttctactaaccatgtgttttaaaaaaaagggtgactagaagttcctgtttatctttgaatttcaataaatttagggcttgttttccaaccactctggtagaatttagaagaacctaacttatttatttttatctttttgacagtcttgctctgtcaccaggctggagtgcagtggcgcgatcttggctcactgcaatctctgcctcccagattcaagctattttcctgcctcagcctcctgagtagctgggattacaggcatgcaccaccatgtccagctatttttttttttttttttgtatttttagtagagtcagggtttcaccatgttggtcaggctggtgtcaaactcctgagct

SEQ ID NO: 340996 - DNA, 530 bp, Homo sapiens
cttggtcattctgacaaaaagtgctcacaggtgccctggtaatcaaggtgagtttcatgatgagggttgcccaggctctacaagtctacccaggctctctgggatgataacctaaatttcaagtagtaatttgagagctgaagaacggggatagagaaaagagagtaattttcaatgaggacattagatgccacatttaaacaattcagttaactctcagtagagaatgaaagactttactcataatggttctttattatcagccagcctacaaagcttatggagctcagtccgactgaggccacctacaaagctggaatgttaataggcttatttccaaacatgtcccaggaaaactaagactacagtgtggctggaattaactttgttcctcacagcttataacctaatagaaacaaaaaaaacacttgaatatttaaaaaaaaaaaagggtgggtgtctagggaaaggaattcatcttcctggctagacagaacagatggataaattattttaatgccatacctctc

SEQ ID NO: 340997 - DNA, 449 bp, Homo sapiens
  misc_feature (182)..(182): n is a, c, g, or t
  misc_feature (234)..(234): n is a, c, g, or t
  misc_feature (383)..(383): n is a, c, g, or t
  misc_feature (396)..(396): n is a, c, g, or t
  misc_feature (399)..(399): n is a, c, g, or t
  misc_feature (405)..(405): n is a, c, g, or t
  misc_feature (411)..(411): n is a, c, g, or t
  misc_feature (419)..(419): n is a, c, g, or t
  misc_feature (427)..(427): n is a, c, g, or t
  misc_feature (429)..(429): n is a, c, g, or t
tccagacattcttaaatttctttcgagtgattcagattcttagccttccaagattcctaggtttccagggccatctaggaatagacctgttgggagggcctaagctggtactgattcataaccctggggagtcctgagaggtcccctggcacttgtctgtgaggtaggtgacctttcctccncaccagcctccatgtgtgggtacagacagtgttgggctgcggggtcctcccnaccagcctctgctgacctgtcctcctgcacttgctttctttgttggcacctggtactccctagagtctgatgagtctgggatccttacgtgacgcatatcacccttatcctgtggactttgggaatgactgcaatccagaatacggggntcattgctctttnccnaacccntcagtnggccccancacaggtntncagggaccttgtactcagga

SEQ ID NO: 340998 - DNA, 329 bp, Homo sapiens
ctgagaccatctgcatagagggcttaacatagtgactggtacttagcaaatgctccatgagttatgattgctggcactggcatgctctccagagtggccctcagaacaggggccctcagccaccaaatcctagacagggcttcctctgacagaggtgcaggctatgactacatggctccagggcatgccactcaccctgcagtccccatggccttgggtggtggttatcacgcttctccatcagggggcggtaaagctctttccgaaagtgctgggattccaggcatgagctatggtgaagctcttaaagaaggggtggcttggccggg

SEQ ID NO: 340999 - DNA, 345 bp, Homo sapiens
actcaagtatcacctgtgggtcactccctctctccccccaacacacacaggcacacaccaggttgagcaaagcaccacccacctggaacttatcctgatgacaggctatagtgataataatcataccaccccttacagagcatagacacggggcctagcactgtccatacactgcttcagtaaactcacataagaaccttttgagaatgggagtatcctatcatgagccctttttacagatagggaagtcgagtctcaaaaccataaccatgcccaaggccacagccaggagcaggcagggccagggtttgccctggactatctctggctgattccctccctccc

SEQ ID NO: 341000 - DNA, 559 bp, Homo sapiens
tctggcccctgtatatggaaaaacaaatgttgtgatgcagccacgggactaagtttctgagcttagttgttacactgcagaatccctttagtactccgaggagcttttaaaacaccaagaaagaatctgtgggtagtgcccaagctttggtatgtgctgccagggatgagaaacaccaagcactcctttagattctgctctcgaagttcccgagtagctgggactacaggttcgagccaccacgcccagctagttttggtattgttagtagagacgggatttcaccatgttggccaggatggtcttgatctcttgacctcaagatccacccatatcagcctcccaaagtgctggggttacaggcatgagccatggcacatgaccagaacatttttctatgtatttattagtccttcatactttttctcatgttaattgccagtacttatgcaagataccgggaaagctttttgacaggaagaagtaagtttctttctcctgtaagcaagtcctgaggctgtataacactccaaattacaaggctatttcaaaatggttt

SEQ ID NO: 341001 - DNA, 109 bp, Homo sapiens
tatacatattgatttactacaacagttttgagagataataatacaatctaggaatctataatgtttcagttattacacgatcatatacttacaaaaaaaaaaaaagcct

SEQ ID NO: 341002 - DNA, 1773 bp, Homo sapiens
attagtttaattcttatccagaaaagataaacacatggttccttgtctacaaagtattcgcctgtttcaatccaacctttgcctgtgtgccagtatgcattactataaagggcaagagactgttgaggggaccagtgtggatatctgcatcattaccttattgggaaaaaaaaaatctaattctacagtccgatgatgttactgccatctcctctgaaaattccaagctccacaggcttcaccaggcttttcaaaatgagagtttattttaatgattaaaaaccgctatttaagtagctcttgccaagccttttcattaccaggtctccatccctccccaagtatttctgcgagtctcatgtgctaagagatgtcttgagcagcctctgcagctttccgtgtttctgtggtcagctactgctgccctttcccgggaggcattccattctcctactgggtcctctcaagatgccaaagcttggtgctgggatttaggaacacatcctgttagatgtcagacagtgctgcttgtgctggggagcctacagaacttctgatgaaactaccatctggttttaccctctgtgccgtggatgcagacgtgtccttgggctacagagaggacatgatggagcaggaggccctatcccaaggaggtgttagaactgggtccactttgtactgcctctttcttcttaggtcacaatgagtgtcctctcagggcacaactcagatcttcaacccatggctcgctgtaggcctgccccgccaggtcctccagcttgccattcatgtttccatcctagccttggttgtgctggaactcaggctggagcctgacactttgcctatatgcaaagggaagaaataggacttacattgccaaggaatcacttcttaatgtttgccagcactaaaaacaacaaagtataggaatctttttcccccacagtctccacaaagctatcaataagtataattcgcatttacaagttttaggccttcaacagatgtaactccatccaaatgaatcaatatgtgccatcaacctaccttatagaggtgtttttcctgattacatgagcaaaagtagctacagaaagatgggtgtaaagaaaaggcaataaattctaggttatgaactctactgcttctggagctatttctgagatttttcagaacctacttttttataaataagtctaatttgagcattctgcaatactttttttcctatcaggaaaactaatgcagatagtattatggggacgtgtaggttttatagaaaaaaaaagtacatgtataattcaaaactcaactttgtatgtataggagtctgctggttgtttgcacagcctgatatgagcacataataaaagtccgtcattccccaaccccctccccctacacacacagcttattttgggaaactgccccttccctgtgtgatttgggaagagaaagtgataggaatcaagttgtcctctggcagcctcctggagagatggctgtgagctcttgctgcttaaacctctagtgccaccctcatttctgacctactgaatgctcagctgtttggcatttcctttgaatgacccagcatcttcccttttgttgtcggaaatcagaatcagtctctattgcttgtaacttaagaatctggatattctgtttattatattcttaaatggttatttggaaaatgtgctcatttataaaagttacagtgtctttttaaagtttgctgaagtaaatgaagcatatcgtcaagta

SEQ ID NO: 341003 - DNA, 601 bp, Homo sapiens
atctccgtgccgtgtccttgttcacttagcctgtgttgagtgtttgtctccatttccaaatgcaataaaacatctgggaaagactaaggtaggtgtgggcaggaagaagggaggaagttagacccagtggcttgagtgccctctgatgcctccttatcctcggctccacacaagccctcgccagtgtgagctccacagccatccacctggaggaggagtactcaaaaccagggtcaaatgccttgtactcgggggtctaccagtaagcctgtggccagccttccacttcatgaatcgtcacatttacatgagagatgtggagggagaggggtcagcctcctagctcctgtcctgtagcagttaagtcaagtcaggccaggctgtggtaaccaagccagtaccttctttaaagaacagttgtttctcattcatacagagtgtgttgtaggtgtgagtgattccctggggcagctgctcttcatggtgactcagctaattagactgcttttctactgggattgtgccatctcaacacaaggctgtcttggttgacttggtaggggaggaggagaagagtcatgcacgaggagttaaattcttt

SEQ ID NO: 341004 - DNA, 1395 bp, Homo sapiens
cagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtctgagtgaaaagctgagaatcaaatggagatctgtcctgacttggatgcctatgttgtaataccataaagtgagaaaaccatagagttgtaaaatctagaaagtaccgtaagataacatctaatctagctttcttattttaaaagatgagctgtgaggcaaatagagtttaagtgaatttctcaaggtattacagtatgtttaaaaaccaaatccttatgtgcctggaaataaacacataaaggatctgacttgaaaataa

SEQ ID NO: 341005 - DNA, 635 bp, Homo sapiens
tatacttcagcaaaaaaaacttttttatatgaaatgatttgtattaatttggcaaattaatattaaatttaacttactctattaattaattaattaattaattattgagacagagtctcacactgttgcccagccaggctggagtgcagtggcacgatctcagctcactgcagcctcccaggttcaagtgattcttgtgcctcagcctcccaagtagctgggactacatgtgcacaccaccatgcccggctaatttttgttattttttgtagagatagggttttgtcatgttggctgggctggtctcaaactcctgatgacctcaagtgatctacctgccttggtctcccaaagtgctggaattgcaggtgtgagccacagcgctgggcctgaatttaacttactctgttagaagacttatgttagaagtcacaagacttcagaaaggacaacatgttttctataaataaaagctaattttgcttcataagatatataggacagttaaattcaatttgagcatatgctttattctaatggtataaaacaaagcatcttacagagtttgaaaaggttaaagcattaattgtgttgctattcccctaaaaagcactggttattaaaatataaatgtg

SEQ ID NO: 341006 - DNA, 662 bp, Homo sapiens
  misc_feature (280)..(280): n is a, c, g, or t
tatacttcagcaaaaaaaacttttttatatgaaatgatttgtattaatttggcaaattaatattaaatttaacttactctattaattaattaattaattaattattgagacagagtctcacactgttgcccagccaggctggagtgcagtggcacgatctcagctcactgcagcctcccaggttcaagtgattcttgtgcctcagcctcccaagtagctgggactacatgtgcacaccaccatgcccggctaatttttgttattttttgtagagatacgntctcactacgttgcccaggctagtgagagccaagattcttaaactggggttcacccatgaacttcaggagggtccaaggaccaagtgaactgatatgcagaaagtgcacacatgtaaacatgtgcattattttcagaaggtccttagcctccaagttctccaggatttcttttcaagaacttccaacctagataaactgagactggtaacccttggttccgctcctaaaatttcatacacatacccagagtcatgtcaaatgaagatctttggacacactagcctgtgtatactatggtggtcccataagattataataccatatttctactgcacctttctatgtttatgatacgtttaggggaacatgcgcaccggtact

SEQ ID NO: 341007 - DNA, 1794 bp, Homo sapiens
cagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagatgtaactagacaaaatgtttaagtgctccaaagactcctgcaaataaaccgtttattgaagagagtgctgcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagatagggttttgtcatgttggctgggctggtctcaaactcctgatgacctcaagtgatctacctgccttggtctcccaaagtgctggaattgcaggtgtgagccacagcgctgggcctgaatttaacttactctgttagaagacttatgttagaagtcacaagacttcagaaaggacaacatgttttctataaataaaagctaattttgcttcataagatatataggacagttaaattcaatttgagcatatgctttattctaatggtataaaacaaagcatcttacagagtttgaaaaggttaaagcattaattgtgttgctattcccctaaaaagcactggttattaaaatataaatgtg

SEQ ID NO: 341008 - DNA, 358 bp, Homo sapiens
ggtttttattctcaaggaatttaaactcttaaacactttttattttgataatttgttaattttttgtatttcaagtcagtcaaaaattttaagatgaggacatccagaatttatttactaaagaggttttggtttctgtatgtggcatttacataggtttcaaaacctttactttggggaagaatgaataaatatagaagtttacgggagacagatcatgatcgatacagtggcaatgttactatagaaaatattcatcaacctagagctgccaagaagcattcttcatctaaagataaggtaagaccataagcatctgttagacgtctgttttttaacagtttattaacaaaagttt

SEQ ID NO: 341009 - DNA, 798 bp, Homo sapiens
cagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaaggccaggccccatcctgattcatctcttcagcataaactgtctaggggcccacagtgagtcagtttgttgatataaactgtcaaatgtggcctgagggacccatcatgaataacagacactcttgtcgctctggaaattccgaggatttagagggtacttcccaggaacctggggagaaaagccagccagatcctttattatataacagtaatgtattatgtattttgttattgtatactttgttacctaacaaataaataatacata

SEQ ID NO: 341010 - DNA, 1868 bp, Homo sapiens
ggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtctgagtgaaaagctgagaatcaaatggagatctgtcctgacttggatgcctatgttgtaataccataaagtgagaaaaccatagagttgtaaaatctagaaagtaccgtaagataacatctaatctagctttcttattttaaaagatgagctgtgaggcaaatagagtttaagtgaatttctcaaggtattacagtatgtttaaaaaccaaatccttatgtgcctggaaataaacacataaaggatctgacttgaaaataa

SEQ ID NO: 341011 - DNA, 456 bp, Homo sapiens
taatgtttgtatttttagtacagacagggtttcaccatgttggccaggctggtctcgaacgcttgacctcaggcgatccacccaccttggcctcccaaagtgttgggattacaggcgtgagccactgcgcctggccactttatctatttttacgtgttcaattcagtggcattaattaaattcacagtgcaggggtaagagttgcacttactttcttaaatttattcctgaggtaaattgatttttatatattgatcttttatcctgcaaaattgctgaactttttaattagttttagtagtttttttagtgaattcattagaatttttacataaaaaatcatataaattttatatataaaattatctctgtgagtacagatagttctgcttcttccttttcaacttggatacctttaatttctttttgttgtctacttgccctgcctagaacctt

SEQ ID NO: 341012 - DNA, 366 bp, Homo sapiens
atgacaggtaacttctcaagagaaaaaatggatgccagaagataatgagtcttcatctttaaaatgccaaaagaagctgggcatggtggctcacgccttgggaggctcaggcaggcagatcactggaggtcaggagttgaagaccagccccatcaacatggtgaaaccccatctctgctaaaaatacaaaaaaaaattagctgggcgtggtggtatgtgcctataatcacagctacccaggaggctaaggcaaaagaatcacttgaacccaggaggtggaggttgcagtgagcaagatcacgccactgcactccagcctgggtgacaaagcgagactctatctcaaaataaataaataaataaata

SEQ ID NO: 341013 - DNA, 98 bp, Homo sapiens
catggaactcaccagaatctttcatcatggaccagctgctttttacacttggataccagtaccctagatggtgggagagactggaaggatcgttcagg

SEQ ID NO: 341014 - DNA, 584 bp, Homo sapiens
tgtatgcagcatgtgctaaaacataaatcaataacaggcctgggatatgggccccagaagaacaccggcctttactgaagtggctatttcttgggcaggactttacaaatttatccttgtccccattccctgactcctctggagaaaggaaaacagcctccagggacttcaggaagctttcaggattacctgtggcttcatgctccagagaggggcacaggagagctattgtgtcctagaaattacctggcatgtgagctggcccggcccttctcctgtacagcaggcccagaactgatctgtgaaagtgtggatctagactacctctgtaaacagaaacctgaagactcagagttggagtcaacacatctggaaaatgacctccgacaaacaacagaaccaccaggtagtcagggatccttcccagtgaaatctgctacctttgggactgatctgcagaagaagcaagtcatggaaacatctggactgcaccatcccacatggacgatagagaaggggtggagattattagcacggtcgcaacttagaggcagggagaactacaaatctatccgtggcaaacc

SEQ ID NO: 341015 - DNA, 122 bp, Homo sapiens
gtcccacattaaatgcatatagagcaaccaaccaaccaaataaacaaataccccatctggaaactattaccctgcaagctatcaataacatgctttgagacttgaacagtcatcatgaggat

SEQ ID NO: 341016 - DNA, 514 bp, Homo sapiens
attgttgtgagtgtgcagaacctgccggtgcgacgtccagtccgtggcgttgaaagacaggatcttcgctcgttatgaaagacactaaagtggatgatacaagaactaaaaaacaaaaacacaaagtatcctgctaaagtggaagtgaaataaaggcattttcacataaattaaaactgaatttgggccgggcgcggtgcctcacgcctgtaatcccagcactttgggaggccgaggcgggcagatcacgaggtcaggagattgagaccatcctggataacatggtgaaaccctgtctctactaaaaatacaaaaaaattagccgggcatggtgtggtggctaatgcctgtaatcccagcctttgggaggctgaggtgggtgggatcacttagaccaggagttcaagatcagcctggccaacatggtgaaactccatctccactaaaaatacaaaaattagctgggtgtggtggtgcatgcctgcattcccagctacttggggaggttaaggca

SEQ ID NO: 341017 - DNA, 85 bp, Homo sapiens
tctggagttatgttgacaaacatgacttgaatgagaaggaagtatttcaagaataatatgacaactgtgtgactacaatgaggag

SEQ ID NO: 341018 - DNA, 445 bp, Homo sapiens
attaagaacatagtaaaaggaatagaccaaatagatatacaaagatcataagtaaaaaaaaattagaaaaccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341019 - DNA, 870 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggtatgtgccctccgccccaccctctcccacctcccaaaaggtttcggggtggctggttgtggtggctcatgcctataaatcccagcactttgggacgccgaggcgggtggatcacctgaggtcaggaccagcctggccaacttggtgaaaccgcgtctctactaaaaatacaaaaattagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaacaacaaaaaggttttagggcaagtctcatcctagggaatccaagaatac

SEQ ID NO: 341020 - DNA, 487 bp, Homo sapiens
agaccccccaggacagtggggagccatggtgggcagcagagcttgtgggaggcaaaggcctgcagagagtctgccatggggcacaggtgctctaggttaccttgaccactgtggccctgccagctgcattcctggtagctcaactgcccaccaggcccagctgcctccatctcacggtgcagctggtgggaaggttagttctgcctcctgggctacaggtgtctgggcatttgttctgtgcctgtggagcccctctgggcctgccccctgaccacctgtgccctctgttccaggtgctggggagtcagggaagagcaccatcgtcaagcagatgaagtaagtgctgtattccagaggcagtgctcaaactccagcttcccctcttcaccctctgggcctgcactgcccccgactacaggcccagccagtcttagccaggcccagaatcttctgagaagcagaaggaccctcaggtcccagtgggtca

SEQ ID NO: 341021 - DNA, 2252 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341022 - DNA, 2831 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaaaaaaaaaaaaaaaaaaaaaaaaaaaaaaaaaaaaaaaaaaaaaaaaaaaaacaaaaaaaaaggaagggggggggcgcgcgtcgagaagtatatccgccggggggggcccaattgctgcgcgcacccaccgtttttgtgtgcaaacaagggggcccccacaagaggagagacgtcatataatctgagacggaggcggacgcaggcggcgttcaaacaacagcaggtgagagcgggggacaaaacagcgcgcccacgggggagatctcctggggaggaggaagaacacccactacgacgggcgggagggggggagaacaaatatgtgtggtgggagacaacaaattctccccaagaaagagaaatatataataaggctcgcgccttgggagggggagaatgatcaaataacaaacatttatgacagagagagtggtctatctagtgtggtgtggataacaccaacagagaggcgtgagattattatgtatgtgaggtagatggtagtagaaaaatattgtttggtctgaccaacggtgagagattgtattttaataattgacgaaaacagtatatttttac

SEQ ID NO: 341023 - DNA, 2149 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341024 - DNA, 2330 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaactcgcgccgattttttttctgaccaaaacatttaattaacaaaaaaatattacaatagctgagaaaataatcttgataacaattaacagaaattacaagtgggagtcagggtagaaaaaaatgcaaaggccttggtccctaagaaaccaacactacatctgagctggccttaaccccagcc

SEQ ID NO: 341025 - DNA, 1895 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgagcaggcgaggcaccagcttgttcttgcctttcatcttctccttcaccaggaagaagggcccgccacttgtccagagggccacgattggggatgtacttgaccccaca

SEQ ID NO: 341026 - DNA, 2160 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341027 - DNA, 2191 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccattctgtggagggcagggcaggggtgccgctcgcacgggggcggccagcagagggacgggtgtaaacacgcagacacactcaaggcacggagtcacttggaaggggggctgggggggggcttgctggtcaggatctgacagttttaaatagtttttctctaaaaagttttctctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341028 - DNA, 1802 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccatcatcttcgcagctttcatatggggcggcggggtgggaggaggcggggggggaa

SEQ ID NO: 341029 - DNA, 2417 bp, Homo sapiens
ccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341030 - DNA, 2092 bp, Homo sapiens
tttaatttcatacggggcgaggtgtttccttataaatgactgttcctgggactttacatttatagggcggggccgagccgggccgtgggccgtgcggcggccgagcgctctaagatgatcgacaagaacctggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341031 - DNA, 1797 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcgtcctcctacaggcggtcgcaggtcccaagggcgacggtgcgggtggggtcagtgtcccccattctagtatgcctctgtgcccctgctcgttatagtaagtttttaaacttataaaagtaaaga

SEQ ID NO: 341032 - DNA, 1937 bp, Homo sapiens
tcctggtccctggctatcaggatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341033 - DNA, 2314 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttggctggggagtcagggaagatgcaccatcgtcaaagcagattaagatccattccacaagattgcgttatctcgagagagagagatagtcccggggctatccgcgcgggttgttcgtactagcaagacaaccagtcacatcgctagtctcatcgatcgatcagtttgtacgacacaatggatgggagcatagcattgctagatctgacgtttagcccgatcacctccagaagctggaccgacgcccgtgggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341034 - DNA, 1834 bp, Homo sapiens
cccgggctgcaggaattcggcaccagctgcagatcgtctttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341035 - DNA, 2091 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcgctacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341036 - DNA, 1353 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatggtgagccagaggggctgtggcagggtgctggggaagaactaagcgggcctggagccccagcagggggttctgggggtgggtaggggg

SEQ ID NO: 341037 - DNA, 1590 bp, Homo sapiens
aagaggatcacaagctttggtcagcacgcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341038 - DNA, 1333 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341039 - DNA, 1187 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacactaagatgggtcagatggacgtgcgctgctgtccaacctgcacctcatccgagcctgacttgatggtctgcatcaatggccagtgatgtactcgtcaaatgtcattggacagcatgaaccttgaacagtcgggtctagacacatagtccactcctggctaacaggcgttatac

SEQ ID NO: 341040 - DNA, 1559 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaagaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341041 - DNA, 1541 bp, Homo sapiens
gagggggaggggcaataggtgaccagggacaagggaggagaaggcccaggtgtgaatcaggaggtcaagtgagtgaggtgcagggcatggaggaggtcatacaagcaggcctggcccagtggtccagacagaagggcctggccttgccctgggacagaaccagaggccatcctgatgttccctggagaaatctcacctcctcacccaccaggccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctcccccacgtaacccagcaacagaaactggctcctgggcggcaactgtgtccctggtaacaaatgggtaggaaaaatagagaagggtcattgtctagggaggcgggagagaggcacgccctggctgcttcccgatccatgctctgctttcccccacctccagggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341042 - DNA, 1028 bp, Homo sapiens
cccttcaatggctccgggacccatgatggggactgacttgaagaccaaagatgctgtgttccatggtcctccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341043 - DNA, 919 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttggctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341044 - DNA, 828 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacaatggctgtgacgccctcaaagcagtggatccacttcttccgctcagaccgctgaccacccacatcaaacatcttgaagtgtaggtccttgaaggtgaagtgtgtcttcacgatccccgtgtctatacgcggtcctatca

SEQ ID NO: 341045 - DNA, 415 bp, Homo sapiens
aattataaatatactacgtaaattcattaaaggagtaaatatgtgaatagaaaaaattatacttgaataaaaacaggaaaaagtagcggatataagttcgaataatgaacagaagaatgtaatgaataagaccatctatcatcctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341046 - DNA, 480 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaattcgccaggggggggtcaacactcaacggctgaagtttcactccatgtcatcataagctgcttttgacaccaatgataa

SEQ ID NO: 341047 - DNA, 345 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttggctggggagtcagggaagagcacctgctcattctcgagctttttaagaaatggg

SEQ ID NO: 341048 - DNA, 417 bp, Homo sapiens
caattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341049 - DNA, 2571 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaaaaataccgagaactgatgggtattctctcccaggggcagaggcctgggctaaggtgtgccaaggtgatggtggtcctaacctcagtcctcaacctgagtcagggccctgactcagctttccgggccgtcctggagccccacgctctgagcttcatttctcccacctggactaggcagcatacatgtggggcccgtgtgtccccgcccttccagtactctgcagccttgggtctcgggcagctgggcaggcttctaagggagctgttgtaaggtgctcttccacacctggagcaggaggggtggccggcctctctagcgc

SEQ ID NO: 341050 - DNA, 1845 bp, Homo sapiens
  misc_feature (1803)..(1803): n is a, c, g, or t
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaccaactgcactcccngtccaaagcgaaacattgaaccactttatcaattacacgaat

SEQ ID NO: 341051 - DNA, 2209 bp, Homo sapiens
tttaatttcatacggggcgaggtgtttccttataaatgactgttcctgggactttacatttatagggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341052 - DNA, 2159 bp, Homo sapiens
ctcgccgttgacgtggcttcttggggtggctgggcctgcgggcgcttctcctgtcgtgtgcctgcagctgagcctgtgccagacctgacttagaaccgctgggaggtttgggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341053 - DNA, 2045 bp, Homo sapiens
ccggaatcgtcgtggtggtgcggacatcgtcgtggtcgtgcggaatcgtcgtggtcgtgtgtggtggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341054 - DNA, 2541 bp, Homo sapiens
ccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggcccctggttgctaaggctcagtgtggggagaagaagggctgctaccctgttggatggagtatgcagggcatcttcctgccagctctgcccagggcaccatattggcatgcaccagctgcacaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341055 - DNA, 2253 bp, Homo sapiens
agaccccccaggacagtggggagccatggtgggcagcagagcttgtgggaggcaaaggcctgcagagagtctgccatggggcacaggtgctctaggttaccttgaccactgtggccctgccagctgcattcctggtagctcaactgcccaccaggcccagctgcctccatctcacggtgcagctggtgggaaggttagttctgcctcctgggctacaggtgtctgggcatttgttctgtgcctgtggagcccctctgggcctgccccctgaccacctgtgccctctgttccaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341056 - DNA, 1961 bp, Homo sapiens
gtgaggcgacctagaggatcccccaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341057 - DNA, 1625 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgtcccaggcccggggccttcagcgttgaacacttccttgcttttttcacatgttttatggaattgttcacctggtttgaaataataaaatgtagaaagaaaaaaaa

SEQ ID NO: 341058 - DNA, 1575 bp, Homo sapiens
  misc_feature (1461)..(1461): n is a, c, g, or t
  misc_feature (1475)..(1475): n is a, c, g, or t
  misc_feature (1543)..(1543): n is a, c, g, or t
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctcgcaaaagggccactccccagagggcagcagatactgagatactctcctgtagtcaagtactngcatgcaggaattncagataagcagtgctactttctttcaaaattttcaagggtaaccaaaaataaggctttcttgcaatgnaattgtcctggacttcccatacacactacaag

SEQ ID NO: 341059 - DNA, 1671 bp, Homo sapiens
aggaatgacactagaagaatgaggcctaagtaaccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341060 - DNA, 1123 bp, Homo sapiens
  misc_feature (1100)..(1100): n is a, c, g, or t
  misc_feature (1121)..(1121): n is a, c, g, or t
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtatggttgnactagtcggggatcctctagntc

SEQ ID NO: 341061 - DNA, 1040 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacgtagcactgggatcctctaggttca

SEQ ID NO: 341062 - DNA, 1451 bp, Homo sapiens
ttgcaggccccccactcagatcaagggaagcaccagacatctcttttggggagcccaggtcatcagggatcttgcaaggcaagttccggtgagctgccccgatgaactctagttttccgtctccttcagcaggtttggcaatctccggtctgccaaagccagacttctcatcttctagttggtctgtctccgcttggagtgtatcaagtcagcgccccttccccgggacaagcaagcttgcatgtaccgggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341063 - DNA, 1363 bp, Homo sapiens
cgtatctggaaaaggggcagcggcctggcgtatgccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctcccccacgtaacccagcaacagaaactggctcctgggcggcaactgtgtccctggtaacaaatgggtaggaaaaatagagaagggtcattgtctagggaggcgggagagaggcacgccctggctgcttcccgatccatgctctgctttcccccacctccagggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341064 - DNA, 1098 bp, Homo sapiens
cggggatagaacactaggcccacctgggcattgtaagagtatgccaataggctccactactggggtctttcatcctttggaggcttgagaatgccaccctggagcaatccctctgtctcgaactctcatggcgccacccttgccgctgaaagtctcacttgtatggtttccgaggcctttccagccaccttccgcttctcgccttcactgttccccttgatgtagtttgcacccaatacgggctgcttgatctcacagtctttcatgagattaaatggcatcatgaaggactcgcagtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaa

SEQ ID NO: 341065 - DNA, 800 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctattgacgatggtgctcttacctgactccccagcacccaacagcagcaacttcacctcccgcgccgccttctctccgtcctcccgcagcttcttgtcgatcatcttagtgcgctcgggcagagcccagtgcggtcggcgctcacgagcagcaatcgcttctccg

SEQ ID NO: 341066 - DNA, 588 bp, Homo sapiens
gccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggggtgaggccgcgtcccgcactgggatccttgattcccagctcgaatccccagacaaggactttgacctcccagactagggcttcaaactcccagacccgggctgtctgggaccccacacctgggccaggaccagggttgaaaactctagattggactagacctttgatcctgcccagactctagaccagacccctgtctcatcccagaccccagacctccaaatccagtcaacagtgccccaacacccgcggtccagtgccctgcttggccatccccccttgctaactagcttca

SEQ ID NO: 341067 - DNA, 421 bp, Homo sapiens
taaggcctgtgctttagtgctttgactcccagccccttgcacagtgtgggtgcttagaagtacatgaatgaaagaagtagacccagaaagaaaagaaaatggatcaggtttccagttgctgcagagtctgctttttttcggagtttggccttcattgtttggcctcaagtcagtttttagaatgtcagatatatccacctttaaatgcaagccccagatttattccaaaccccagtataaatggttattggtttctcgcagttgttgatgtgtgtttttttgaaaaacattcacatgcttgttcttcgatcattgagagtaaaccgaatcctctgagtctgaacaaaaacttaatttttgcctgaggagagaagcactgggtttaaaagacagagagaaagccaaaaagaaaaagaaccca

SEQ ID NO: 341068 - DNA, 588 bp, Homo sapiens
tgcaggagctccagtggcttctgcaaatgagggcttggcaattatcagtggacggacacagagtgtccagcaccaggccatgggccttcctgcttcctgagtttcacaagtaggatgcacatgaggggtgcaacccatacctctgttgaaggaaggctgtagtactttccaggacacagcctggacgaatgatgccaaactttctatgcacagataagtcaaccacagttgagccaaggtaacactcagggatctggctatccctagtttgtcccccatcaatgaccaaggacaactgaggccagaggtcttataactccatggcattcagagaactgtcctgggagctgaggttggcactagtgagagcaagaggatgctcatacatcttggccaagtcttgcataaaggcataatcaggaatccggataccttgtaagaggagtaaaggggtttaggtcgttgttgagctcctctgaacgttccatcaccagggacactggtcctggcactaggtctttcaggagctcctggggtgctactctcatacagccagtaacttggccttcctgcagcccttgagacggt

SEQ ID NO: 341069 - DNA, 127 bp, Homo sapiens
cttcacaggcactgaccattcagatgctaacacacacacacacacacacattcatcttccccaaattcatcttgaccccaatactgacccccaaagaccctaactctccagacccaattccagacat

SEQ ID NO: 341070 - DNA, 86 bp, Homo sapiens
gaactgaaaatctcatctgctgcagtatgagtgcaaacataaaaaggtaaaaacactttagaaaactgctatttttttcttttctt

SEQ ID NO: 341071 - DNA, 313 bp, Homo sapiens
acaccatcactgtaccagccatgggtgccgcaaccccagcaaccccatggaaccggagttccccaggtagtggccagtgtcaggccatgtgtcctttcctcaaattaaaaggacctcgctagcctgagcttgagaggataaaatggcaagaaaggacttctgttgcccaaagtgcagtgacttgatttcatgtaaattgccatagctaccttctcaccaaggctgatcttccctcagtttgagaagtccttgtgtttgggtgggttgtatggtagggggggtgtgtgtgtgtgtgtgtgtgtgtgtgtgtgtg

SEQ ID NO: 341072 - DNA, 283 bp, Homo sapiens
ctccatagataggctttatgagatctgtgaattcattctaattgcatgcaatttttttgtatatactcattctagagagttaatcacatttttataaggatccatgacctccaagagattaagatccacaatcacaagatgttatgagctccaaggcagctaatgaaatcaaagtggaaagacctgctattgacagcagcacctgatgggctcaaacctggtagcatgaggtagtggcagaagaacatcacagcaaatgacagcaggaaggtgctttgtgcta

SEQ ID NO: 341073 - DNA, 621 bp, Homo sapiens
catggggacagaaagatggaactgaggccatgagtaattatacctgaagaattttgtccttgtgccagctctgatcatgtgcatgtgtgcaaacatgtgcatgtatgtgtgaaatcactatggcaggtccccgggtaagcatagccagaacacttacatggttgagaaatggtcttgcctcttggcccaatcatcgtttcaactaaactttccaacttaatgaaactgcttctccagcacccctgccactatgggttttcagtggcccacggtctagtagattgattcttgccctagttcctggtctaatatgcccaggcagctatttaacatattaaagatggccttgctgtcttagactagatctccacatctgggacttcctctgttgacctgaagtttcttctagtgtctgcccagaatcttgggattcactgttaccctgaatcttacataatatttggtttgttggcttgatttgatattcagctttgttttaagtaattgcagactaatcaagactgtggaaagataaaacatttaataagttatattgccttggattttaagatcagtcagaaagatatgagaaaaaagatagggtaccaatataataaattt

SEQ ID NO: 341074 - DNA, 192 bp, Homo sapiens
caattctatttcctaattattttctctatccctactatgcctggttagtttaactttacaccctacctccagtgattttttttctaaatctgttcttcacatgactttcagagtgatctagctaaagcagcttctcaaccttagctctcaggacagttgtgttgggcacgggacagctggagcctgcgcctg

SEQ ID NO: 341075 - DNA, 610 bp, Homo sapiens
ctgtgggcttcatacgtctgtagactgcatacacctgtgggcttcatacacctgcgggctgcatacacctgtaggttgcatacacctgtgggcttcatacatctgtgggcttcatacgtctgtagactgcatacacctgtgggcttcatacacctgcgggctgcatacacctgtgggttgcatgcacctgtggactgcatgcacctgtggactgcatacacctgtggattgcatacacctgtgggctgcatacacttgtggactgcatgcttgctggtagaaggattttattaagtagcttttattatctttatttcctgactataaaatcttgttttaggtagaccactgtgtaacgtttggaaaaagctcaaaaggagaagcaaaatttccataactgcttgaccaggaagtgtcctgggagatggtaaactgccttaaaggagtcagacccatcctccctgcttccctggtcacagcctgccaagaaaagtcctatttcaggagtgattaccctgcaccaggcatgggtctaagtgtgtcatgtacattatttgacaaatatttacggagttaccatcaggtgtcaggcactgttctagaccctgtg

SEQ ID NO: 341076 - DNA, 499 bp, Homo sapiens
agcttgtaaaaatatttccctcagggttttttcctagtctgtttgtttcacagctgtcttaaggaaaaaagtaggataaggtatagctattaatgttctataggaacttacaagtgtctggctagtgatccgtcctataaatacccgtctacacatgctcaactttaccattaaaatatagaaaacattaaagtactattcataccacagtcctacctggaagaatggtatctgtctacctgagtgggatgcctattattattttgttccaacatagtaacatatatgaagaatgattgccatttgaaacaaattcgtttttttttttcttttttttcttttgagatggggtcttgctctgtcacgcaggctggagtgcagtggtgtgatctcggctcactgcaacctctgcctcccgggttcaagcgattctcctgcctcagcctcctggagtagctgggattacaggcacgcgccaccacggccggctaatttttgt

SEQ ID NO: 341077 - DNA, 524 bp, Homo sapiens
actttgcttaaatgtggttgtggattccacttcctctgcacagatatgttttgtacatttatagaaactctatttttatacaaatcaggaacaccagagttctctgatgaccaaattttcattatcaaatttaatcacaaaatattcattattgaaattaattaaaatgtattatcaaaattaatcaaattcgatttcttaacctgacctccaagaacactgcaggaaatgctaccattgtcacaactaatttgccaacggaaattaaaaagaaaaaattctaagaagctgattttgaagttacagtaaaaattagtgttgcaaaaaaagaaaacaagcacttacatttcattgaactagagactgaagaacaatcacatggtgggccagactgttcttctggtaggaacgatattaaagtataccaactattacaccaaaaatatgctcagtggccagtctggataactcttcacatctgtgctgggctctctggatttgctacttcaccatgagcccaccct

SEQ ID NO: 341078 - DNA, 245 bp, Homo sapiens
attaaactaaaagattccccaagtaggcactgtcctaagataattgtattctacttaagtttattgtggtatgtggcagtgctctataattaacatatatatatatttaaccagcccttacaggtgatagttttaggatagaactttcaatttcttaagttttctttgtatctttgaatccttacgttaaggatgatcagtaagaaatttccttcaggagttgtgatgaggaacgtacatttatt

SEQ ID NO: 341079 - DNA, 137 bp, Homo sapiens
tggcagtatcgtagccaatgaggtctatccgaggcgcgattattgctaattgaaaacttttcccaataccccgccgtgacgacttgcaatatagtcggcactggcaatttttgacagtctctacggagactgaattt

SEQ ID NO: 341080 - DNA, 353 bp, Homo sapiens
gagatgttcaggaagcaattggagagacaggtctggaggtcagcactactagaggcagagatttggaaaatatctgccaaaagcgtaagtgtcacaggagttcatgaactgtagattcagaaaaagtttaaggaagaaccttgtaaataccatatgtcagaggtaattggagaatatggaattaaaaaaacaaaacaaacaaacaaagccaggagcaatgactcacacctataatctcagcgttttgggaggctgaggcaggcagatcacctaagatcaagagtttgagaccagcctggccaacatggcaaagcccagtctctaccaaaaatagaaaaaaattaggtgggcat

SEQ ID NO: 341081 - DNA, 586 bp, Homo sapiens
ttgggaatactagtattcccaatacagtatttcagccctatgcttggaagccaatttgaacagcaaaatcaccaaggaaaaatacaaaaatgagcggaaaaaaaggcactaaaaaggttgtgaaaaggacacttgtttacagtatgaaacaagaagacagagcctcacacattgccaggtggcaacatgaatgttgggcaactcaaatttttctccactctgcacatgtccacaagtgacccaaaaagtactttgtattgattttgtgtttataaatacatgctagtgaagaggcaaatttacaaatatagaatctgcaaataatgaggtttgactgcatatatttataaattataaacattgattgttttctaatgaaaataagatttcccccaaatgtcaattttattattaccatcatacatcacctaatgacagagacatgttctgagaagtgcgtctttagatgttttcatcattgtgtagacatcatagtgaacttatacaaaccaccccgatggtagagaccactacaccacctaggctatctgctataacctgttgctcctaggctacacacctgtac

SEQ ID NO: 341082 - DNA, 179 bp, Homo sapiens
aataaaacctttccaacagacagacataaagggatgtcaaattcagtttataggccaggtaaatgttaattgctaaaggtctgtaatgattcaaactttatagctgtgttggaaagaccaatactgcatattgcatattaatttaaatttgcggtgtcctccacattggcattagcttg

SEQ ID NO: 341083 - DNA, 317 bp, Homo sapiens
attgcaccactgcactccagcctgggtgacagagtgagaccctgtctcactcaaacaaacaaacaaacaaaaccttcgctttccctgcgtagagttcctatttttccattcattttgagagggctcacccttcctcctggagcacggtggcgcagctgctctgaagatcttgtggatcctccaccaggaaggatcccaggttggtgtgtgttgctcatttcccagctggagaggctgagggttcctatttcttcctatgctgagtacggacgtcgagttgtcctctggtctgtttgaatattgtcgtaacactccag

SEQ ID NO: 341084 - DNA, 306 bp, Homo sapiens
gcctgcaaactacaaactcgagtgaggaggtgggaaaaggatgcctagcaagagaggcggggtagggagtgggggacaatttttttttttttaaggaatctgtctttcaaaaaagccccaaccacaaaaccatatgtatattcgattccagggcctggagaagacaggccaggaaagcaactgtctgttgaaatggaactgaaggagccacttatgtgttaacttgtctgaaaaacagaaggggatcctggcctgcaactccctctctctaaaatcagcagttaggtgcaaatcaatgaggaggct

SEQ ID NO: 341085 - DNA, 376 bp, Homo sapiens
tttgagcctctgcgcccggcattcttttttaaaagataaaaaagtctggctgcagaggaaccttatacctgaaatgttttgctgtctgaattcactccagagtgaaatgacttgaagtacaagttttgtgactgctccgagaatttttgtgtcagaggcttctccttctgccattttttgaacatttacctagaattacaaaaaaatcattccacatttcacagtatggtgctaggaatctgaccaggtccagttcataattttaaactttagagttttaaaaacatgtatgcttatcatgctgtaagcaaatgggaccccaggagtaaggggtaactttctgtttttcctcattaggtttcaactttctgtgctg

SEQ ID NO: 341086 - DNA, 617 bp, Homo sapiens
ccactaatttttgtatttttaatagagacggtgttccaccgtgttggccgggctggtctctaactcctgacctcgggtgatccgcccgccttggcctcccaaagtgctgggattacaagcgtgagccaccgtgcccagcgccccatgttttctttccttggtatatctctcattgcacctcctctcctctctctctcacttccgtccagccacatcagcctcctagctgatctctacttctccatgctagttcccaccccagagtcttggcacccgctgttcctcctgtctggaaccttcttcccccagatctctatgtgtatcctccgcttttcctccttcaggtctctgttcatgtgcctgatcctttgaggtgccctccttaactcagggagatacgtctccttccaggccctcaccaacctactactactgctcccaatgggagccacatcatgtccagcctaggacgctaaatttgacccagggctcagatgggagcagaacaggcctcccctaaaacattcctttttttccttttcttttttttcttttctttttttttgggggggaacccgatatatcccagtctcggccatctacaggggggcccacca

SEQ ID NO: 341087 - DNA, 423 bp, Homo sapiens
ctatatacataaatttgacaacttagatgaaatgtatcactttttagaaaaatacagttacaacttacccaatatgaaacagataatttaaatagcccgatactattaaggaaaatgactttgtaatattttattttatattacattatttttaaaagacagcgtcctcattatgttgtccaagctggagtacagtggctatgcacaagtgctatcatggcacactgcagtcttgaactcctggcctcaagccatcctctcacttcagcttctcaagtagtggggactataggcctatgccaccatgtccagctactttgcaattttaaaactcccccaaaagaagtcttcaggtggccaggcatggtggctcacatctgtaatcccagcactttgggaggccaaggtgggtggatcacctga

SEQ ID NO: 341088 - DNA, 339 bp, Homo sapiens
taaaaagaaaatttaaggttaatactaaaaacggacttcttttatctatgctatgtcaagttaaagagtaaaaatagcaacaactacaaaaagactatccttttgacagatgacttaagctttttttttttaattaaaaaaaaaaaaggtagctaatataattggagtgtgcctgtgtcccaggaataactttaatgtcaggtgtcctccatagcactctgatgagtcaggtatcatcaataagtatattggtataatataacattcgggagatctttgaccctggagtctgacttaagagccgatggttaccactttacacaattccagaggccaaca

SEQ ID NO: 341089 - DNA, 1270 bp, Homo sapiens
gctgtattaggatttaaaaacggaacggtgaaggtgacagcagtcggttggagctgagcatcccccaaagttcacaagtgtggccgaggacttatgattgcacattgttgttttttttagtagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttggtcccccaggcctaagttcagagccaggcctggccctgaacttaggtgtgcctgtagcagagatccctcagggaaggggaaggaggatggtgcgggaagaagctcaaggtgagaaggcagagaaagggggcctagaaaccctttgttcatcctgatgagattcaggatttgagtagaggagggacaagatctgggaatacacactcaggatccttcttgatgacagccttccaatgctttaagggaacagttccaaagtcagagccatggccatctagtgaaaggtaccaagagacagcttttagttcagtgtatggcagctttagaattcaagtcgcccaagcaatggtctgtgctgcttcatgagtttagtgtccctggatttgcgcttaaaaaccaccagggtccatttcaacgtgaacattcagtgagtcttcccccttgttctacaagtgtttcctgacattggtcctgacttcggtggggtcgcagatggggaagagcagagcaggcgcgtggaggtgcaggggatgctaggagaggaagtggaggctggttcatggagacacaggggagcagtgtgagttcctagaagaacttcctagaagttcccatggttcagaaaagtgagggggcctgccacggagagactgagcattgggcatgaagagggcatgggtcatgagatcatggaggaaaggcctggggtaggctagagatctttcaagaagcagcaaaggatgaatggaagaattgccaagggcagagcttagagcggagtgaccaaggtgaccatcagagtcttgtgaggtgtgccccccgggtgggaaaaggaaagcttttgtttcctagggaccacaggtacctgagagaaagatagaggactgtctggcatagaaatggggaggggagg

SEQ ID NO: 341090 - DNA, 245 bp, Homo sapiens
caacataaaaagatttaccagaccaagaatatataggtagtatgtcaggatttcaatccaaatatactcaactccaaagctagtgtcttccctactttaccatgctgccttcctggtgaaggaggtttcagtggctgctttttgggagataccctgtagactatctaggacatagtaagaaattaaatccattatagggattagaaagagggcttattgttatactaattgacagtgacccaaaa

SEQ ID NO: 341091 - DNA, 296 bp, Homo sapiens
tggatggatggatggaatgggtatacaagcaagtaggtgaataaaagtttaggtggatgaaagagtggacagatgagtgaatggctagtagatgtttgagaggtggatgaatgaatggatgagtgattggaaaggtaagagggtggatggaagggagggttgatgaataagtggacagaagatgaagtacagaggtggatggacacacgaagggggatggacacacgaagggggatggacacacgaagggggatggacacacgaagggggatggacacacgaagggggatggacac

SEQ ID NO: 341092 - DNA, 106 bp, Homo sapiens
catggcagtgacataagaaatttgggaagaccatggctttcttgaaagcaggaaccaagtcttttattccagagttaactttatgcctggaaaataatgagatgct

SEQ ID NO: 341093 - DNA, 298 bp, Homo sapiens
ggagatggcatttaactccgtcacccaggctggactgcagtggtaccatcatagcttactgcagtcttaaactcctgggctcaggatatccccctgcctcagcctcctgtatttgctagcatttttttgaggatttttaaactttgttttcataagggtcattgcctgtagttttcctatggtgtctttttcttcctttagtgtcatggtaatgttggcctcatagaaggagttgggaagactcccctcctcttttattttttggaagagtttgagaaggagttatgttaattcttct

SEQ ID NO: 341094 - DNA, 275 bp, Homo sapiens
actgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttcgctatgttgcccaggctggaccccaagtcctgagctcaagcgacc

SEQ ID NO: 341095 - DNA, 184 bp, Homo sapiens
ggagacataacaaagatctaagataatctataatgctagaaagaaaaggtgtaaatgccttgaaaacaaatcctaaaacaaagactaaagaaaagaaacaaagaatttttggaagaagaagctggaatgacatcatctttgtttctgaagctatagaaactggaaggggcctgtaaaagaaaaa

SEQ ID NO: 341096 - DNA, 584 bp, Homo sapiens
actcataccaagagaaagggaaggaagaagtttccagctagttagttaagcaatttctcaacacatttatggaagcatgtggaatctttcaagaaaggggttacgatcacaaaagttcgatttgaggagtattctccaagacaactgagaagcaagcccttagtcatgcccaggtggggagcaggtctccaacctctcatttcctgatccagcccctttcccagccacatttctggcctcttccctttctctgtggtcatcagcccagccctctccactatcaatagaaaagcccgagagccctcagagagcctggaatgtgctcccaccgctgtgatgtcatcccacatcatccatgtgctgaaatcagggactggagtcggcccccaggaatgtcatggccatgggctttgagacactcttcttatgggcctttcacccaatccagaccttgcctgctcttcagagctgcttgaaggattttgctacagaactatggacatttaagaaatgtctaaccttgtgtcagtttatatttgtagaacgcttcataaggtgcttttccatatgttatctcatctgat

SEQ ID NO: 341097 - DNA, 461 bp, Homo sapiens
aatgactaattcagtgttactgctttgttttattatttttcttcctttttggcagaaggatgggcaatggggaattctctatacagaagctgccttctaattgctaggactcccttatggatggtacatgtggataaaagagaagctgggtggtgcctgtgtggtccttccttactgtccattgtctcatggagccccgtctcctcccccacccagcttctgcaggatcatgcatgggaatgtgtgagatcagcccctgggaacagggggcttctctagagggagttccctgtgtgtctgcagactgtcatgggtcctcagcacctccactcccctgccaccccttgaacatggagtgacttgtcccagggatcaggtatatctgtgagcccagagggagcaccatgatccaatctagcctccccgctccacacccttcaccctttgtggatgagctctgt

SEQ ID NO: 341098 - DNA, 922 bp, Homo sapiens
gttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagtactgccttccccaggccctgcccttccccaagaggaaaacacaggagaggaaggaatggctgctggtctcctcatagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctgggatcaccaccagagcaaagcctttctgaagcttcattcccagaaccatgtgttagatgcccctggggattcgaccgggacgtgacctgagagaggttcatctgggaccagcctctccggaaaggtgccggaacgagactcgaattggaacccgggagttgaatggagacctgacccgagaacctttgtggggggcgtccaggtctctcg

SEQ ID NO: 341099 - DNA, 551 bp, Homo sapiens
caaagacttttccagctcccccaaaactgccaacgttaaccacccctatcaccctagatcctaaggccactggcaagatgaaatgtgcttgttttttcagggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctgggatcaccaccagagcaaagcctttctgaagcttcattcccagaaccatgtgttagatgcccctggggattcgaccgggacgtgacctgagagaggttcatctgggaccagcctctccggaaaggtgccggaacgagactcgaattggaacccgggagttgaatggagacctgacccgagaacctttgtggggggcgtccaggtctctcg

SEQ ID NO: 341100 - DNA, 108 bp, Homo sapiens
cctctctcctttttccctttcctcctttctcattctttcttccttcctttcttgttcctccctcccttccttctttccttcttttcccataagtaggactgaaggaag

SEQ ID NO: 341101 - DNA, 290 bp, Homo sapiens
aaaaaacacattttttggttgggggagaccaacctcaggaaattaattctctgtactctagctgtcacattcacaattaattagcttaaagttccttgaaagaacatttatgctattgtggcttgatttgcttgaaatagtagaaatctgtgggacttcaggagggtgtggtggtataaaacccttggctttcacaactggtttttctctttccttgaggataactgacattaaatacgctgaacaactgtggtcttcaaagaagtttttagagaacctgatccttaagt

SEQ ID NO: 341102 - DNA, 106 bp, Homo sapiens
atctcctctgaccaggcttcaaggctgacattcaccagggttccctgccacccctgccttcacattgatcttctcatcctttatacttcccctgagctacctgatg

SEQ ID NO: 341103 - DNA, 372 bp, Homo sapiens
ggtactagatacattttctgtatagaatgtgcacactgattataaagtttgtccaaacttccatctttaagaagaaaggcacgtaggccattactttaatactttacatttcttaaaagtttagacctaaaatagcaacaaacctggaagttacacacagcccaaagcaataattaaagtggaaacattggaagttacccgtaattacacgggtctgcagaaaataagaggggcaataattgtgcaggtcgtatgttccctgagggctccttcttaagcagagcagaagagcctagtaacagtaagctcagggaggagaggagcaaagagtacagatggtggatgtgaaacagagatcagtggagatcaaca

SEQ ID NO: 341104 - DNA, 386 bp, Homo sapiens
ttgccacagacctccacgttgaagctcatgtaattggaacatgcccagatgaaccatgtatgaaaccatgggcagaacctaagtgctaagatggaggcgcaagaactgaattaagaaggagacactgaatgacaggattcaggatccaatcatatggagccctgcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggaga

SEQ ID NO: 341105 - DNA, 416 bp, Homo sapiens
aagtagtagttttctgttgctgtgtaactaattaccacaaacttagaggcttaaaacaacacacattttaaaatctcatggtcctataggtcagaaatgcagtaggcttggctgggttatctgctctgggtcttaggaggctgaaatcaagttgtcagtaggactgcattcttttctggaggctctggagataaatcaactcccacacttatttgggttgttggtagaattcagttcatatggttgtaggactgaggtccatgtgtccttgctggatgttagctgatggtcgttctcagcttctacaggccatacatttcttgccttgtgatcctctttctttcttcatcttcaaagccggcaataggaggttgaatctctctcatgctttgaatctctctgactcatattttttt

SEQ ID NO: 341106 - DNA, 630 bp, Homo sapiens
gcaaagatcatggggaccatttctgagtttgtctatccaaggaaggggactgtgctgaggacaccggagtattagtgcctccctgggtaccatgagagggggcaacagaggagtcagacacacatgcacaaatacagaaaagcacagctgagactgagaaggagcaagaggaggagagtcagggaggctgagaggctaaacaaccaagaaagcagagttcagagaagttgactgcactgtgaaaagctgagtgtgattttatttgggagcatgcctctggtgtttttcaaggctatattttcatattcatcaggccctcaccgactggggagaccagaatgaaaaagtcattatgtgtgtcttcaaggatctcacaatatcagttcaaacataaatgtaagagggtgaaagtgttgaaagcatggttttctcttcccccatgaggatggccttgtcctgaaaatccaccacttgggaattggccagctctgactaggttgagatctcagggtctgaggaggctgtcaagcctctgcctcaagttcttgagcataatcccaacatctgggacattagcaaccttcctgtatgccaagaaagtagctggattagccagagtctgtcttgact

SEQ ID NO: 341107 - DNA, 1058 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaa

SEQ ID NO: 341108 - DNA, 546 bp, Homo sapiens
ctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcatgtcttatttgcttcagaagtggcagaggagaaagtgacttgcctcacgctgcccggttccacccagggaccttgtgaagagacgcgggaaggctggcagaaaggagaaccgtccttcccgtggaatactcccgagatcgcaccactccactccagcctgggtgacaagagcaaaactccatctcaaaaaaaaaaaaaaaaagg

SEQ ID NO: 341109 - DNA, 967 bp, Homo sapiens
ccaacgcgttcgcccgagcgtcgcgaatatgatgcgattcggatgaacctgtcgtgctctttgctcttcagtaaggtctggagactacagaatgactttgcagaaccggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaatggaagaaaaactcaaagggccggctgactatgaaagagggcacccagagctgaacatctgagtccatggaggtaggaccatcgaggcgctgggacacagatgcggccagcctggacgtgctgtgggacgagcacgacctgacgcagaacaccgcggcattcaacacgaacctaagagacgcgagagcgcaggagcgacacagaggggggcagacgggagagcaaccggagcgcggagagagcgacatacacaagccgcgaccagggcaacgctggaacagcagaaaggagaaggagagcaaggccaagggagacaacaacgcgggaaaaacagccaccggacagcgaacgacagagcgcagac

SEQ ID NO: 341110 - DNA, 457 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgat

SEQ ID NO: 341111 - DNA, 3172 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341112 - DNA, 3124 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341113 - DNA, 5563 bp, Homo sapiens
  misc_feature (2)..(5): n is a, c, g, or t
  misc_feature (56)..(57): n is a, c, g, or t
  misc_feature (2573)..(2574): n is a, c, g, or t
gnnnnccgcggcgccgggacagccccgggactctgccaggtggatgttgtgcgtanncggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccnnagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggaca

SEQ ID NO: 341114 - DNA, 2225 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcgcttactgtactatgtgctggctgcagctgctgctccgctaaatgagtagcagctt

SEQ ID NO: 341115 - DNA, 6478 bp, Homo sapiens
  misc_feature (2335)..(2336): n is a, c, g, or t
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccnnagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatgg

SEQ ID NO: 341116 - DNA, 2531 bp, Homo sapiens
  misc_feature (7)..(7): n is a, c, g, or t
gtctttncagtcaaaagtccttgaagctgggaccctttgaaagtctgtcagttacatgttgttggtagtggcttgttttgaccgtttcaaaaaaggaagaaaaaaccacttaaatcatttttcctttctcttttctactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341117 - DNA, 2211 bp, Homo sapiens
  misc_feature (1844)..(1844): n is a, c, g, or t
  misc_feature (1846)..(1846): n is a, c, g, or t
  misc_feature (1854)..(1854): n is a, c, g, or t
  misc_feature (1858)..(1859): n is a, c, g, or t
  misc_feature (1865)..(1865): n is a, c, g, or t
  misc_feature (1874)..(1875): n is a, c, g, or t
  misc_feature (1880)..(1880): n is a, c, g, or t
  misc_feature (1897)..(1897): n is a, c, g, or t
  misc_feature (1899)..(1899): n is a, c, g, or t
  misc_feature (1909)..(1909): n is a, c, g, or t
  misc_feature (1919)..(1919): n is a, c, g, or t
  misc_feature (1942)..(1942): n is a, c, g, or t
  misc_feature (1950)..(1950): n is a, c, g, or t
  misc_feature (1970)..(1970): n is a, c, g, or t
  misc_feature (1975)..(1975): n is a, c, g, or t
  misc_feature (1990)..(1990): n is a, c, g, or t
  misc_feature (2000)..(2000): n is a, c, g, or t
  misc_feature (2012)..(2013): n is a, c, g, or t
  misc_feature (2041)..(2041): n is a, c, g, or t
  misc_feature (2043)..(2043): n is a, c, g, or t
  misc_feature (2139)..(2139): n is a, c, g, or t
  misc_feature (2188)..(2188): n is a, c, g, or t
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccgtccacctggccgaggcagcccagagccagcgggatgagctggcgggccagagaacgccaagananagaaaaanaaanngataangtattgccnnacccntccgccgttccccaccntntgccccccanccctctggcntctctaaaaactgctgctgatgnagacaagnacagagcccgcccccacccngcacngcaagcccctcactncaccctcctnccaggccctccnncccgggtggtggccggcacctctgaacntnacgtgggtcgcggggcgggcatgtcccaggtttgtctgagacagtctttttttattttgtattgttatttttattatttttaatttaaacctgatnacttgcacagcatctttcccaccgggaagagcgggcctgctgccttccnacctgcggggtgggggtggaaca

SEQ ID NO: 341118 - DNA, 5784 bp, Homo sapiens
  misc_feature (1641)..(1642): n is a, c, g, or t
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaaagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccnnagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatgg

SEQ ID NO: 341119 - DNA, 972 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaaagtggcagaggagaaagtgacttgcctcacgctgcccggttccacccagggaccttgtgaagagacgcgggaaggctggcagaaaggagaaccgtccttcccgtggaatactcccgagatcgcaccactccactccagcctgggtgacaagagcaaaactccatctcaaaaaaaaaaaaaaaaagg

SEQ ID NO: 341120 - DNA, 310 bp, Homo sapiens
actctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggc

SEQ ID NO: 341121 - DNA, 453 bp, Homo sapiens
aacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtgattttccatt

SEQ ID NO: 341122 - DNA, 960 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaactgaaggcgacgagattgaatgttctgacgggcctggaaagggcaaccgagggcgaggtgctcacagagaggggagacctagggaaaggcctcatcgggcaacactcccccgcgtgggtccaggtccaaaggccacagtgggcgccacagggcgaccgctgcacaaaaggaagg

SEQ ID NO: 341123 - DNA, 3625 bp, Homo sapiens
taaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctccatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctctcgacaaatgttgagctctttgttcttcttttctttctttccttccctttcagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341124 - DNA, 6716 bp, Homo sapiens
  misc_feature (2)..(5): n is a, c, g, or t
  misc_feature (56)..(57): n is a, c, g, or t
  misc_feature (2573)..(2574): n is a, c, g, or t
gnnnnccgcggcgccgggacagccccgggactctgccaggtggatgttgtgcgtanncggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccnnagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatgg

SEQ ID NO: 341125 - DNA, 3123 bp, Homo sapiens
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341126 - DNA, 6423 bp, Homo sapiens
  misc_feature (2335)..(2336): n is a, c, g, or t
agcggtgtgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccnnagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatgg

SEQ ID NO: 341127 - DNA, 1779 bp, Homo sapiens
atgctgaaagggaatattccgtgcccattgtgcggaggcacctcctcatcgcttcctgtcacctgcagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341128 - DNA, 1438 bp, Homo sapiens
ttaggctaggtagcgaggctgggtggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggtttggcatgcgccaaagaaaaaaatcaaacaacacactataatataaaagcactatcatagaaacatagacgaaaaaaacaacaaaccaaggcggaggcgcctccgcctacataatctatcccccacgcaagggggcgcccctacactgtgccgcgtctctcccccgcctttcttactttctctccagtggtggccct

SEQ ID NO: 341129 - DNA, 594 bp, Homo sapiens
agaagtgatcatcacatataaggaatcctcaataagattatctgcagatttctcatcagaaacttcagaggccagaaagcagtaggctgatataaagtgctaaaagaaagaaactatcaactaagaatcctatatccagcaaatcttcacttcaaaagctggaggattcacacttctttgtttcaaaacttaccacaaagttacagcgatcaaaacagtgtggtactggcacaaagacagacatatagaccaatggaatagaacacagtccagaaaaaaaccctcttagcacaagggtgctaagattatccaatggggaaaagatgatctttttgacaaatggtgctgggaaaattgccacatacaaaagaatacagttggacccttacctgataccatttacattaaattaatgcagactagatccataacctaatgtaagaactaaaactataaaactcataggagaaagcatagggcaaaagttcacaacattagaatgggcaataatttcttggatataacatcacaagtacaggcaacaacaacaacaaaagaacacaaattggattgtattacaattttaaaattttg

SEQ ID NO: 341130 - DNA, 415 bp, Homo sapiens
ttgtagctttgtggatggagggtgtgggggaggccgtgtgtagtgaaaggaccacccggctgaagacggtcctgggggtggagggcaggagggagcgagaaggacagttctgctcctgggagcctctcgttcctgggcgagggtctggggaccctggatgaagttttaggatcttttacaatgacggtctggggcagagaataaaattttgcagggagcagattgagggtctggaggactgggttaggtgggctctaggtacccaggacgatctcgggaggcgcacaatgagaatctgggggctccaggattacggtgtgggtgcacaggatgaaattctgggggcgcagattaggtaggatctaggtgagcaggatgacatttttggtgagcgttgggacgctcggcgtgtgca

SEQ ID NO: 341131 - DNA, 460 bp, Homo sapiens
ttttttttttgagagacaggtctcaccctgttgccctggctagagtgcagtggcatgatcacagctcactgcaacttccgcctcctgagatcaagcaattcttctaccacagcctcccaagtagctgagactacaggcgcacaccatcacacccatctaattgttgtattttttggtagagatggggtttcactgtgttggtcaggctggtcttgaactcctgacctcaagtgatccacccacctcggtctcccaaagtgctggggttacaggcgtgagccactgcactcgaccagtggtatcatttgttttgccgctcccctaatgctggatgtttccagctttctactattttttaaatgtttcgatgagagttgttctctatgcatgtgcaagtacttgtcagattatttccttataataaattcctagaaggtggattgctacaaacaagaaatgt

SEQ ID NO: 341132 - DNA, 416 bp, Homo sapiens
atctcaacgtgctaattgtagttgtgttagggttataagttatggttgattatttttcttcttctttccaaaattttggcaatgtgattatttcttttaggtgaaaaattatagttatgattttttttttcttaaaagaagaagctgggtgcagtggctcatgcttgtaatcccagccagcactttgagagactgaggccggaggattgctttgagcccaggagttctagactagtctgaacaacaacacagcaagactgcctctttgaaaaagaagaggccatcactttttcccttattattggttaggtttcagccattattcctttttacttgctgaacttttcctaaatcctccctggaaaaatacgagcataaagcatattttagaaaatggaaatttattttggaatgta

SEQ ID NO: 341133 - DNA, 242 bp, Homo sapiens
ctcctggtctgtcttccattttgctttctttcagctatgtcataactattgttaaaactattgaattcttcactttatttacattatttttcagttctagattttctgtttattttttatagatttaaatttacttgcaaaattttccatttatcacttattttattgaatatgttaatcatttattttaaagcatctttctgataaatccaatacatggatcacctggaggttattggcat

SEQ ID NO: 341134 - DNA, 435 bp, Homo sapiens
gaaacacaccaggaagttctacaggcggatcctttaactcttatttagagtctgatggtgtgctgggatccattgcgaggtgggctggtcagctacaggaccttccttccagggatgattgtgtttttgtgaacccccatggccgtaatccagtacgattaccagccacaaatcatcagacttcttctttgctatatgaatatttttattacaaaagtcagataaccaagtaaaaatgctttaaaagattaacagttgggaaaatgggtcagaatcacccacaatctcaaaaatttagtgtaaccactattggaacaatggcttagttccttttggatgttttgcttgtgcatcacctttgtggttttattgttataaattagatgccctcctttattttcccctcttaaaaatatcagaagcagttttctgtaa

SEQ ID NO: 341135 - DNA, 225 bp, Homo sapiens
tgctgggattacaggcgtgagccactgcacctggccagttgaaggattttaatcaggttaaatggacaaccaatttttcttttttaagaaaaatcacttttggctgcagtgtggacaaggcactgaaaagagaggacaaagctgaaggtagagagacatttgaggaagttgggtagtctgagagagatgactatgagatgaactagcttagcggcaggagggttg

SEQ ID NO: 341136 - DNA, 227 bp, Homo sapiens
tggacagcagcagtccaagaatgagagctggtcccagggtcagggggttcctggcagggcctgtgcatcagcaccctgagagtaggcccagaagcagcagctgggcccctgagaggccaaatggcccgagaccgctgccctcaaatctcagggagaaacaggagaccatgctgccaccgatggtgactccctcagggcctggctaaaggggcagggacagaaactca

SEQ ID NO: 341137 - DNA, 237 bp, Homo sapiens
gggctcatttatgtctttatgcacttagatttttttttaactctatgtattataatccagtattcttattctgttactcagattgtcgtagctttggtcattggaagctcctgcagtttgggtcctatgtcctttcatcatgttttcccaatttcttattttcagctaccacaggacactcagggtgcatcttgaattttctttgctccagctctggagtcaggcacttgagggagc

SEQ ID NO: 341138 - DNA, 249 bp, Homo sapiens
ttgcacaaaactattccatttctcttacaagaatagcctatgggtgggcccgtaggctcagaggtccttatctgcagcaagcctaaggttttgtgtgttttagagacaaggtttcacaatgtcatccaggctggagtgcagtggttccatcatagctcactgcaccttcaaactcctgccccgactttccaaagtgttgggattacaactctttttgcatttctctgactctccagcagggggcagcct

SEQ ID NO: 341139 - DNA, 225 bp, Homo sapiens
aattcccgactctgccagagaccaaaaatagcgcttgattcttcccactcatcttattttcactgacccctcaccttcactatcaaacacttaataagcagttaattctagtaacagatatgagatatggttcctattcccaagaagcttaacaccaaacagtagtaacacaaatacctcgacccacctgcttaatacaaagatgactagcaggggaggaggaca

SEQ ID NO: 341140 - DNA, 189 bp, Homo sapiens
tctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatc

SEQ ID NO: 341141 - DNA, 281 bp, Homo sapiens
ccttccaagggcatttgttctctccaacccccattccttcttccattctagtttatctcttcaagcttctggccaattctattccatcatgagtccacttactacctattcctctgcctactgtccagtttcttttctatcagctttaagcctactaagcaggggtcaattcatacttaccactctcatcctccaaattcttggcttggctatagcagttcatcagccacctcaccactctgcccctttctcatacacactcccacaggacaccaccacta

SEQ ID NO: 341142 - DNA, 316 bp, Homo sapiens
aaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagt

SEQ ID NO: 341143 - DNA, 410 bp, Homo sapiens
gaaaatgacatagaggcagggaaaccattaatggctggcttctggacacatctgttatgaagtgtgaagcagagttaactcaggaagttcccaaagaactgaattttggcccatagagagtttatgaaatgaacagagaaacaagatgtctcttcccagtcttaggtatctgtgggcatccattttaatacctggtttcttcagaattagcctgtgacacttttctgtatttctgaaatatttttctaacatgtgcttctctctaaaagacctggtttgtagtaactgtatgtgttttttgtttgtctgtttttgagatggagtctcgctctcgccatgctggagtgcagtggtgcgatcttggctcactgcaacctctgcctcccgggttcaagcgattctcctgcctc

SEQ ID NO: 341144 - DNA, 457 bp, Homo sapiens
cctatctacctgcgtgcatctgtacccatatatcccatattctttccttaacaatggataaatcattatgtttctgccgagggccagactcttctcttgggctgcagtctctctttctgtcctcctctgctcaaaagtctccgatgtctgaccatctcacacgtgaagccagaatgaatcctcccagtggcctccagtccctgcatgacatggcgaccagtcacctccctggcctcatctcccagtgttcactccttcattcaccccattctagctgcctggtctcctggctgccccttaagcactctaggcctgcccttgccttgggaccttggcactttgcaggtcctctgcctcttccctggattctgagtaggttcgctgtgcatctcctttaagtctttggtcaccttcctagcgaggcctttcctatctaacaccacatgcacacatcccc

SEQ ID NO: 341145 - DNA, 368 bp, Homo sapiens
aaaatatagttgtcttcccaatgaaagagaacatatggcttcctataactagcataacatttaataaagagatggactagttcagattccaatacaactaagctatttatttctgtgtcacagtacagttcctaactaactgaaattagttcctgataagaaactaaagctatttttcacaacaggtaagtcgatggcctgcctggagatagacggtgtgatggctgcacagcaatgtgaatgtgcttaatgccacagacttgtacacttaaaaatgattaaaatggtaaattttatgttatgaatgttccaccacaataaaaaaaaatagtggatagcctgaatattaatttctgtgcccatttcaa

SEQ ID NO: 341146 - DNA, 257 bp, Homo sapiens
ttttgcataaaattctaaggtcttcttggatctctgcagttcaccaagggacccaggttaataactcctgttctagaaaacatgactttctgtgtgctgatttctttggattatccccagcacagctccctgtgggaggaagctgttgtcagaagcaagctgggggtagtgatggataatgaaaactgtgtagaggacactggtagcgactcactggtgagaaccctgaagcggcgtgctgggggccatctcatgac

SEQ ID NO: 341147 - DNA, 211 bp, Homo sapiens
tgaacagggaagcaatatgttaagttgcacttaaggtttttaaaagtagtgacaggattatctccaaagaagatacagaagtggcaaagaaaataaaaataaataaatgaaaagaaaaaaataaaatgacaggattaattaggtggagagtcagggagaactttaaggaggatgcttgttgatgattgagggcctgaactaagtgggaatg

SEQ ID NO: 341148 - DNA, 209 bp, Homo sapiens
cagtttggtgcaagtattgatgacattcaaggcttctctgaaacttcctttctggataaggcatatcactttacaatgcaggccagttacatcatctttgtggatctgcagtatcttattgacaggcttgagagcacacaggaagttgctgttctggccgtaccggttcacttcactccacacagcacaggcactgaaactccaccctg

SEQ ID NO: 341149 - DNA, 244 bp, Homo sapiens
aaaaagaaatggcttggttgttcttactatttatttatttattccagaaataaaaatactttttcattttcttatttcttatttatttattcttccaaagaaacttatctgggaaaagagaagtaatagcaagtttgtgtgttgataggaattaacaatgggtgttggaaaacattgatgatacaagaagaaaaagagctgggcaaggcgggtcacatgataatcctagtactttgggaggcta

SEQ ID NO: 341150 - DNA, 238 bp, Homo sapiens
ggattccatacacctggggacacaaaataatcttgctctcttaaagagctccagttctggccaggcacggaggctcatacctgtaatcctagcactttgggaggccaaggcaagcggattgcctaggcaagcggattgcctaagctcagttcaggagttcgagaccagcctgggcaacatggtgaaaccccatctctactaaaatacaaaaaaagttagccaggcatggcagtgtgca

SEQ ID NO: 341151 - DNA, 311 bp, Homo sapiens
cagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacctgtggaacgtgctttgcgtttttgtgctgttgatctgctttcctgagacatgattggaagtcagcagctccagcctgcatgttcccagatcacctgtaagagttctta

SEQ ID NO: 341152 - DNA, 361 bp, Homo sapiens
tatctcatggccccacgttaaaacactaaatgtcaggtgatcaacagctgaaatactaaaatgcaagaacccaataggttttacccaacggcaggaaattagccctttcgcatgaatgaactgtttcagatcaatgaaattgacctctttaagaagcatcaaaataatttttaattcagaacttttcttaatgtgtattcttcatttcccagtatttcttgatagacacagaggcattgtggacactgactactgcactgtcccataagagtcgtgcaagcgaggactttgaaaggaaatggtattcctcagccctggagtaaatgactcgcagaccactggcccccgctgttgctgtgtg

SEQ ID NO: 341153 - DNA, 130 bp, Homo sapiens
gatatgaatgttctatatcctccctaaacctactatgtatttgatttattcattattctagtcttggaagacaattaatcactaagggaacatttttctcatcttttttttttttttttttttttttttt

SEQ ID NO: 341154 - DNA, 87 bp, Homo sapiens
tgctgggattggtgtgagccaccgtgcccggccttctaataaatattatgctcgtacaatattcgagtgctttcttccccgcccccg

SEQ ID NO: 341155 - DNA, 151 bp, Homo sapiens
aatgttcctaaggggagacctccaacaataagacaagttgctttttgagggcataaatctctcatagtcaacagaattgctgaaagaactcttagaaagattttagaattcattctccaattgcacaggagatgtaactagtgactcacta

SEQ ID NO: 341156 - DNA, 278 bp, Homo sapiens
gattgcactccagactgggcaacagggtgagaccctgtctcaaaaaaaatagaaaaagggaaaaacggtaactcaaaccaagggatcaaggttagcttcaccagtaataagagatactgttatcacataccacttacgtgatgcagaaagagcacatccaggccggacacggtggctcacgcctgtaatcccagcactttgggaggccgaggcgggcggatcacgatgtcaggagatcaagaccatcctggccaacgtggtgaaaccctgtctctact

SEQ ID NO: 341157 - DNA, 357 bp, Homo sapiens
tgccatgaaaaggtgtcttctcagagaccctgctcactgtaccaaatctgtttcaccctccactggatggtcaggctgtgtgcagggtaaactataacatgaatgtggccaaggttaaaagtcaaataaatgctgtccagggaaggaccagtgcatgacttgaggtctctgagaacagacaatatgcatatcaagctcaactggtacattgtttacttacagcaagaggagaagagggaatgcataaatccagccccttgcagtgtgtcagtctccatggctaatggattcaccctgcagccaatgtaggcagtgcggctaacaatttgtgaactattttagagtttggaataccaa

SEQ ID NO: 341158 - DNA, 215 bp, Homo sapiens
cacctctggtgcatgcctataaagaaatggtggcagaaggaggaaaaaggacttaccagtgtcacacaaccagtaaggcataaacctaggactcaaactcagatctgcctgccccagaagctaagctttaactactaaaggcaaagaaagaacagaagtgtcactctctaactcaaagttaaaccctactctctacatcttactctccacacccc

SEQ ID NO: 341159 - DNA, 209 bp, Homo sapiens
atatttatccaaacaaaggtcaacttttaaaccacagtagttttctaaaaagtccatcaatgaagaatgtgcttaaataatttaaggtccatttatgtcatggaataatactaagtactaaataatactaaatactaaataatactaaagtgaaaagtcaaattgttttatatatatgtattttatatatatacatatatatatatgta

SEQ ID NO: 341160 - DNA, 545 bp, Homo sapiens
caaggcagtgaggcagaggccagcatcttccaggaaggggcagagacaggaatctcagaactgcacaccactgaaataaggagagacagcaggtggcataatctgaaatgctgtacgcttcaaaaaaactatttcttttaaaggagtaaacagagaaatggtctggaaatggcaataaggaggatcctgactcatatctagacattgcagaaataaatcgccacagttggagaaggctgtagggacagtgatgtcctccaggcttcagttatggcaggatgaagaagaaaatgttttggtttaaaaaggcccaacttctgcacagctctgacctgtgacttgctcaaagacctagagaaatttaccacctatcctattcatgagttttaagatgactttcaacaagtgaggcttttatttatacatacagtgtagccagaaaaggacttaccatgcaaagaaaacacattttaaaagtatttcacaaggaaatctagatttagtcttggcactttctgtacgtattcattttatatccccacttc

SEQ ID NO: 341161 - DNA, 799 bp, Homo sapiens
gcacgaggaaaactacgctctttaattttacaaaatcatggattttcgtggtgatagcaatggatgtgaagaccattaggtgaaaaatggataggaagcttataatgcatggagcagaatgacaggacactaatctatattaacatctctaaatgagatcagccagatgaacttgatgtgatgaaatggatacacacagtggacacctgtgaagttttcttggctcccccaaaactgagaagtacaagttagtctccaaacctaattaccagtttacaggaaacatggggaataaaagaacaaattaacaacacaaagaagcaaacaaccaaatgcacaatttgggaaattctgcagaagtaatggcctagttttttaaccaatacatgtcaaaaaaaaaaaaaaaaaagacaaaaatggaatcctacactttaaaggagactaagaaacgtatccttcaaatacagtgtatggagcattttaggatccttgtgttaaaatgcgcttgggatttgttttaatcaatcatggtgagacaggcagacatggaaattattgtcatgaaggaagaagtttatacgcagatcccacaaacgggaggcatggcatggcatgcagggtcacgtaaagaagcacctgggtgtatcaggaggcagagggtgagagcacagcatggcccagagcttttattgggggttttcatgggaaggaatggacaaggcaggggtaggcacactggtaagcttaggattgaatagtttgagtaattttgttggtctctgggatctaggggggattc

SEQ ID NO: 341162 - DNA, 357 bp, Homo sapiens
catgcagggtcacgtaaagaagcacctgggtgtatcaggaggcagagggtgagagcacagcatggcccagagcttttattgggggttttcatgggaaggaatggacaaggcaggggtaggcacactggtaagcttaggattgaatagtttgagtaattttgttggtctctgggatctaggggggattcgtaattgtctagttagggcaggggaatattgaattggtgtatgagagtttggtaaaggagatagttgggagtatgggctctggattggttggtttgtatatgaaaggcatgcttgcagtggagtttatcatctatgcattagcttgccctgggaggggcagcctatcca

SEQ ID NO: 341163 - DNA, 488 bp, Homo sapiens
tcaaaaaaaaaaaaaaaacacaggagagacaactggtttttgaatgaaatacatgggtactgccttgcttgacatcacatagtccttgatgaaagttcacatttaggtctgcttggtacaatacgcctcctaaaaaggtccttgatgaaagttcacatttaggtctgcttggtacaacacgcctcctgaaagggtctgatagctttcagtagcagtaagacacttgcatgtgatggtaaggtatctgcaaatttgcacacaccgtacacagcttaagtcttagaattaacttgctaaaatgtgagcctttggtaattaggctgttttattagggagtgtgataatatttgaatttcttttcatatttgtgctttgtgtcattttcaaatgacccttgaaatgtattttaaaactagataaaagccagaaagtgatttgattgtctatccagcaaaagatggtggttcattttcttgtcctcttaatac

SEQ ID NO: 341164 - DNA, 365 bp, Homo sapiens
tatagaatatattatttataatattctatataatatataatatgtattatatagattatagaatacatagaatatattatattctatatataatacattatatagaatataatatatattttacatattatatagaatataatatatattatatagaatataatatatattatatagaatataatatatattatatagaatataatatatatacatattttttgagacagagtctcattctgtcacccaggctagagtgcagtggcacgatctcagctcactgtagcctccgcctcaagcgatgctcctgccttagcctcccaggtagctaagattacaggcagataccactacacccagctaag

SEQ ID NO: 341165 - DNA, 482 bp, Homo sapiens
tctgaataccatataacatccttgttggatatgatacagaattcgagctcattccaaagagcaacaaaatgtcattcttctgagagagttattaataacacagcctactcagggtctaattattcagtgtgcagattatacaagctcctttttcctccttctccgtctctatctttttcctagttcccactctccaaccatttcattactattctgcacttctgccagaatatgcacagtgatagacgtgtttgactgtctatgggtctacaactgccctgattgtagaggaaaaaaggagttgctcacacacaaggatgagagggactcacttgccttccacagatgccagagttctcatgcttagaacaccttctgggaggaggacattatttctagagcaccactgagaaaacgcaaagatgcattggtgaatatgttaccaaggcaatggttcgataaaatgcaaaaacagacggtga

SEQ ID NO: 341166 - DNA, 304 bp, Homo sapiens
ctgttcccccaaaacctgttgacaaaaaagtagaaaataaaactttctgattaaaacaacaacaaaagcccagaaatgctattgcttatggtcattaattcttttatcctgcaacctctcttatagtggttgtctgttggctgacagaataaaataataattaatagtttgtctacctgttgtttctgttttctcttccaatatttataccatgttggttgttttcttcctgtttttattgctgtgtaccaaacactccaaaacttaaggcctttaaagaaaaataaaatatttcttacatttc

SEQ ID NO: 341167 - DNA, 293 bp, Homo sapiens
ttcatttaaaaaaaaaaaaagtccaattacttaaatgttaatctcatccaaaacaccctcacagaaatatgcagaaaatcttccatcacatacatacctgggcattatggcccagccaagttgacacacaaattaaccaccacatatggtggaaatagagcttcaaaatgatgttccaaaggcaagcaatattatacttttaaaatctctgggaatataccccttttgtatactattttgaaatccttggaaatacacaatttttttatacttcagtgtagttttaaggagca

SEQ ID NO: 341168 - DNA, 537 bp, Homo sapiens
actctatgctttgctcatcctttccctggcctgagcctcatcctccaggaagaatcaccagctggtggaagccccactctggagccagcccggagcccctgattcactaaatttcctccacagaaagttcctcgggccactctggttgccaggatgcctgcttatcccgtaccctctcaccgtcccctcttcctccataaggggagcaagaccaacaaaaagcaacccaccagtggccgggtgaggcagctcacgctcgtaatcccagagctttaggaagctaaggcgggaggatcacgtgagcccaggggtttgagaccagccccagcaacagagcaagatcttgtttcgtcaaaaaagaagaaaacgtatctgggtgcagtggtgtgcacctgtagtcccagctactcaggaggctgaggtgggagaatggcttgagcccaggagttcgagaccagcctgggcaacatagcaagaccccttctctacaattttgtttttttaattaactgccatctatttgggagtctgaggtag

SEQ ID NO: 341169 - DNA, 186 bp, Homo sapiens
agcatttatcccaggagcaggggcaaaacttccctaaatgtaagcgttttaattggacagttgcactttgatcatattctatgagttgtgggtgttccctataccaggtacgcttactggttaggcttgggggcagattctctgccccccagttactctctctttcttactcgccagcaggaccct

SEQ ID NO: 341170 - DNA, 523 bp, Homo sapiens
cctcaaccatctggaatagtgcccagcacatactggctcaatgaatatttattgggtgctcaatgagtatttattgaattgagctgcgtataggacacgatggtgcctaaacaatgcaaagttagttaacgtgcccattctttaaatctctcttccattaaatctgcttctcctgtggatagcattaacagcctctcagttttgtaatcacaaaatccaggtgtcattgataacgccctttctctccttatatccaccccttcaaaatcattcatcaagtcctgtggagtccaagaaaacaaatacctttcattttaatctctcctctctgctccatcttggtttaagccacatcttctttcccaaaccatgttgaagttgacttcccctgtcctttcccatatggcaggtagagttattcgtctaaaacacacactgggctgggtgcagtggctcacacctgtaatcccagcacttgggaagaccaatgcaggcggatcacttgaggtcaggactttgagac

SEQ ID NO: 341171 - DNA, 107 bp, Homo sapiens
atgttgttaggagatttacattactggcagacagtttggggatgagatagtgatgtgtttttttaagtgcagaaaattaagcaaataagaaaagacatttatgaact

SEQ ID NO: 341172 - DNA, 735 bp, Homo sapiens
aaacctgtagatttggagtaagaagcagagaggctagtgagagagttcagggtttaggcctgatttctatcctcttccacctaccacttgttgcatttccttcactgtcagaatttgattgttctgtgtctgtatcttcagatgtgtttttcctagtgtatttgaaaaactgttgaacagtcccctctgggcagggagggaagagggttagacaatcaggagtagagactctgttatttctctctccagacctagaccctggagttaactgaaggtccagagttactgaggggcggctgtgtttgtttttcagtaggctggctttactgagtgggatacaagagcccaaagcacaggccattcccagaagcctaacattttcatatttctttctctgccaaagaatctttggttagggttaagaataactagtctgtctgtggaaataccaaggccttttgtttgccagaagaaaagcgcttttgattaaggctgccttttctctctctcttttttttttcttaagctgttgtgggaagacttcagagcctctgaaggtgccgtatttaaggggtgtaggggaaggaatgatagctaaatagaactaagggagacttaatcgtgctttaccgcacatttgtgcagagattaacaacagcaacaaaatctacccagtttttggtcattgcttctactagcctttctttcttcctgtcttttatgaaatctacccaa

SEQ ID NO: 341173 - DNA, 231 bp, Homo sapiens
acaaacacttgttctgctgtttctgtggcctggctgagccaagaaaacatgttaaagcacagagcccacgcaagacagtgtgcttgcaggagaccctaccaacaggaatcggataacaaggagctaaaggggtgataatgagaagcaatggactagaggattcaagtggaagagtcttcatcacccgcaggggaatcaggagcaatgttcatcagtgaatgaaaggagtgc

SEQ ID NO: 341174 - DNA, 542 bp, Homo sapiens
taagttgacacctcttgccaattaatagcacttatactaatttataacccctccaaaatatgtgtgaaagtacaggttttttccttatccttcataagcagagtacagttaagtttttgaacttcaataatgatatatgttgttgtttaactttatttctttaaattattaataagtttgaacaccttttaatgtatttatgggccagtgatatttattttcatgtgagcttaactgttcatgtgcttggttcatttttctttttaatttgttgttttttttcctcattgattttttttcctttagagatggaatcttgctatgttgcccaggctggccttaaactcctattctcaagcagtactcctgcctcagcttcctgagtatctgcattgatttttaagtgcttcttataccttaagatattcctttgttgaacgtgttgaaaatatttttcctagtttgtcattttgtctttgactttttttgtgcttcatttttccttgcagaaagatttaatttttatgtagacaaatataaat

SEQ ID NO: 341175 - DNA, 332 bp, Homo sapiens
attcagatggtcacttaagcctctaatatatgatgtgtatcttcaaaaacaagggagccactcacacacagctctcagatgtgtgcgatgagcaccatcacaaattccttccttaatgcactctgctttccagctgacctgaagcttgcaaacagcaattctgatggtaaggagggtaaggaggaaatcaaagtccccaggtcactagtcagatctagccacagaagtaccagctccttttactctgcttatttgtggtaataagttattgttggcatgaattctgttctctaatctagtcacagtgtgggagaaatttttaaatctagcct

SEQ ID NO: 341176 - DNA, 258 bp, Homo sapiens
tgaatctgactcatttcttgactttatcattatagcttccacccttcctgcaacctctactgcctgattagagtcctaattttaccctctccctccctgatgcataggtaaaggcccctctgtggagtaaggagatcttcagagctgttagtgtaactaattgagaagtattgtttccattgcgtgttctactcatgttgcttctcttgtgaaccattaactttaattggatattatttttacctgtttctggaaaaa

SEQ ID NO: 341177 - DNA, 610 bp, Homo sapiens
agaaataattaaaataatgtgtgtgcacatatatatgcatattataaaacattgaactacataatctataaaatctatcaatatataacatacaagtatgtattgcaaaacaagtgaaagagtgaacctcgcatttatatattaagtgatgctgcttaaataaggaaatatataaaataactttggtaaatggaaacagttttggtgaagattcttaattcacagggtagaactcaaaatggttctctgaaaatacagtctagttctctaatgttttagagtaaagttgcatagaataagtaatataaatttattgataacctaactccaacattattcattataattactattttttttttttgagacagggtctgactctgatgcccaggccgaagtgtagtggtgcaatctcggctcactgcaactcccactgcccaggctcaagtgatcctcccacctgagcctcccaagtaacagggaccacaggtgtgcatcactgtgcctggctagtttttggattttttgtagagacagggtttcatatgttgcccaggctggtcttgaactcctgagctcaagcagtccacctgcctcgcctccccaagtg

SEQ ID NO: 341178 - DNA, 398 bp, Homo sapiens
  misc_feature (242)..(242): n is a, c, g, or t
  misc_feature (245)..(245): n is a, c, g, or t
actctgtctcaaaaaaaaaaaaaaaaagatgagaactttagatattgcatagccacaaagaaggaggtatcagattaaaatatgcaagtgtctcggggtcacagatagcgctgcctggatatttaaggtactgtgaccttatacagtcatcgctgtccgaggtgtcatacaccaggttgttggcgaacatactcctgaggaaccgcacgggctccagccacgactcgatgagcagcaggganatncacctctggtttagattgcatctacatggcgcagcctccatgtcgtagggtgccatagcaccttctaaaaactcaataatgcgaaccgagactggcccaccattgatgcacgtgtggattcccgatttagtgttccatcaaggcggagtgact

SEQ ID NO: 341179 - DNA, 117 bp, Homo sapiens
agtggaccaggcagttgaccccaaaagggaagcacaggacaaaggccctggggggacaaaacccacaaagagcgtcttgcctgcgaaagggcagaaggtcccccttgagcaaaagaa

SEQ ID NO: 341180 - DNA, 813 bp, Homo sapiens
gagccccaagcttaccacctgcacccggagagctgtgtcaccatgtgggtcccggttgtcttcctcaccctgtccgtgacgtggattggcgctgcgcccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgtccctctatgtctctttgtgtcgctttcattatgtctcttggtaactggcttcggttgtgtctctccgtgtgactattttgttctctctctccctctcttctctgtcttcagtctccatatcttccccctctctctgtccttctctggtccctctctagccagtgtgtctcaccctgtatctctctgccaggctctgtctctcggtctctgtctcacctgtggcttctccctactgaacacacgccagggatgggcctggggggccctgagaaaaggagggtttgcgtggggcggggtcaacctggtattccagacctggggggcacgcgggcaaggcaggtagatcacctgaggtcaggagttcgagac

SEQ ID NO: 341181 - DNA, 1157 bp, Homo sapiens
  misc_feature (1126)..(1128): n is a, c, g, or t
gagccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttccccccaaacccagcaccccagcccagacagggagctgggctcttttctgtctctcccagccccactccaagcccatacccccagcccctccatattgcaacagtcctcactcccacaccaggtccccgctccctcccacttacgccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgaggccctcaatcctatcacagtctactgattttcccattcagctgtgagtgcccaaccctatcccagagacttgatgcttggcctcccaatcttgccctaggatacccagatgcaaccagaacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagtnnnactggcggtgttttaactcggatcggcta

SEQ ID NO: 341182 - DNA, 504 bp, Homo sapiens
caaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagcctgggttctctgcgcccccgtgtcttttcaaacccacatcctaaatccatctcctatccgagtcccccagttcctcctgtcaacc

SEQ ID NO: 341183 - DNA, 1220 bp, Homo sapiens
gagccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttccccccaaacccagcaccccagcccagacagggagctgggctcttttctgtctctcccagccccactccaagcccatacccccagcccctccatattgcaacagtcctcactcccacaccaggtccccgctccctcccacttacgccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgaggccctcaatcctatcacagtctactgattttcccattcagctgtgagtgcccaaccctatcccagagacttgatgcttggcctcccaatcttgccctaggatacccagatgcaaccagaacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagcctgggttctctgc

SEQ ID NO: 341184 - DNA, 609 bp, Homo sapiens
  misc_feature (1)..(1): n is a, c, g, or t
ntcgctctagagtatcccctgcacacgccgagtctccagactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtga

SEQ ID NO: 341185 - DNA, 663 bp, Homo sapiens
ggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtga

SEQ ID NO: 341186 - DNA, 586 bp, Homo sapiens
caaataccaaatcatccttcaagttttttagctcaaatactgaaatagctgaaaacctgtctctgaaatccccatgttcccacagcacttggacgaatctccatttgaacaatcatctcagagtattcttattgcacatctacccgctcctacctccatatagattaagctgctggaggacctagaagacaaggtttttttttttttttttgagacagagtcttgctctgtcgcccaggctggagtacagtggtatggtctcagcttactgcaacctccacctcctgggttcaagctagattctagtgcctcagcctcctgagtaactgggattacaggagtgtgtctcggctaattagcctggctaatttttgtaattttagaagagacagagtctcaccacgttggccaggctggtttcaaactcctgacctccagggatccgcccacctcacccccccatagtgctgggattataggtgtgagccaccacgcccaaccaagactgtctttgcattgtagtaaatcctagtgtctagcagagcattcagccaagtggtacagtatttgttgaaggcatgagtaa

SEQ ID NO: 341187 - DNA, 181 bp, Homo sapiens
cattgtatttatcaaatatattttcaaaccacataacaacagttgaagagcagcttgcagcttatgtaaaatgtcatcagagaagccaactagtatttctgtaaatagtagtagtatttaatttatgttacccatctctgcggattaaaggaagtattctcaaggaaaaattcaattaaag

SEQ ID NO: 341188 - DNA, 292 bp, Homo sapiens
acgatcccgtccaggattccacatgatggtcgggagcatctcctcgggctcctcctggctgcgacagtttctcagaccctccttgttgtgatggccttggaagctttgaagttctgatgaggcactttggaggatgcccattggctggaagaggtctcatgcttttctcaagattagaacctctgtaactgggttccaggtttgggggaggatctacgacattttttaaaaatataaagcactcgaccaaacaaagtaacatgttaaatatttacttatttatttattttgg

SEQ ID NO: 341189 - DNA, 739 bp, Homo sapiens
aaggtggaaaaagagtatttcttcatttttcactcttgttacatgttttgaagagtttgaagacagacactgcataaagtaacacatgaaactacctggtttgaatttttctagatcataccacaacttctgcttaggattttgtctcttgagattaaatcagcaagaagaaatgggacaaactatctatcatccatagatcagccagtagcaagatatgccaatgtggcacttcagtttaagagtcaagaagactcagtggtagaggaatgtatttactgcaaattcctgtcttgagaccttgggaggagagaagcatatgctccgagacagataagaatagacagccttttcttggttgagtggttagctggaggagccaggctacttctttctgcagtcatcctaggaagatcccagcatcagcagggcccagctacatgctctcttgcttcctccccactcatcgatgccacccctttcccctcaaaggacacaatgcaaagcctcctctgtgtgggacgacatcagaaaatggggaagataactgggacaggaaatgctattttcgtccctactgccaagggcaagggcggctgacaactcaagtggagagaggtaaggatatcctcacacaagggcccctcttataaggacaaggctttgcaagtacctctgaccccctcccccacttctctccaaaataaaggaaaataaatcatcctgagcaagtctggaa

SEQ ID NO: 341190 - DNA, 443 bp, Homo sapiens
cttttgtttgtttccgtgtttctcctgtatcttccacttagattgtcctttctcatctcttcatgtacaaaatgaacctcagagccactctggacccttcactgcaagaaaggtgtagtactttctttgaattcccgtcatgttcaaaatgaacctcagagccactctggacccttcactgaaagaaaggagtagtactttctttgaattcccgtcatgttctctgtgtagctctcatacttcttaattctgtctactttttacggtgtttgtgggtatggattatctctctgacaagactgtaaattccttgagggcaaggtcaatatcttggcctcatgttcatttctcacagctccttgcatgtagtagctgctcaattaaatacatgcatgataacacacaaataactgagacccaatcagtgctaaagtagtaatatc

SEQ ID NO: 341191 - DNA, 176 bp, Homo sapiens
cactgcactccagcctgggcgacaaagcaagactccacctcaaaaaaagaaaaaaaacccacaagtcccaaaaccaaaactggtatttcccatgtacattcgaccttaactgttgctcattcaacccagcccaactcagtgccccatcccctggccctgaagagaccattctggcc

SEQ ID NO: 341192 - DNA, 103 bp, Homo sapiens
ggtctatgacattactatgcttttattctttcatcctttgggaactccagttatacatatgctgagtttcccttgtttattcttgtatatatagttttattta

SEQ ID NO: 341193 - DNA, 229 bp, Homo sapiens
tccagcctggacgacagagtgagaccgtctcaaaaaaagaaaaaaaatcactgtgcctggcactgatgtggatgttgggcaccatttgtgacaagagagaaaaaaatccctgcattggtggggcttatgttctggtaagtgtccgtaaatactgaacatcaataaatcatgtagtatggcggaaggttgtaagtgccatggaacaaaggagagcagggtatagagattt

SEQ ID NO: 341194 - DNA, 388 bp, Homo sapiens
cttttcttcgttgaagagctctgatgtattgccttgtctcgaatgcataattgatcattatgaaaagaatacaggttgttcctgttgtctgttcttccttcttctctagtaacggaattttgaactaggtaaatggctatctagagtcaagactacatttcctagcttctcttgttgctaggagtgcacctgcttctggccactggggtttgcaactattttaaaccatggagttgaggtccccaagacagagaaacaagatagaaggcacctgcacctttgatatttaatgacaagcgatgaagtaccatgatgaaaacagccccaaacccctaactacactttcatgtttcatgtgacagggaaataaacttctgttttgtgtaat

SEQ ID NO: 341195 - DNA, 672 bp, Homo sapiens
ctccttggtgatcagtgtctattgaccgatgagcgatttttctttcactaacagcgatggttaagctaagattaaactaatagtgcatggggtacactaatacaactattacaatgctaaattgatgaaagctggttgagagggttggttttcaccctgtcctctgagaacatgccttgtggacagaagaggatactgtggacagcacctgggattgctgcaccgttgtctgctttatatgttgaacattggggctcaattctgaggtataaagggtcttaagctctaaaaatggttgtaaacgcctcacccagataatgtcttttctcatttttgctgttttatgttctgaggtaaaaggatatgttaatcttcttttcaaaaatatccaaaaggaaagaattttttttgctcattgaaaatcttattttcttttaaagaaggccttagcaaagcaccttaagagaaatatacaatttaaaatagaaaaaacatggccaagtagatattactgactgaatttatttcaaactaaacaaaatgaatcttacaaaacaatttttttctgtgtgttaggtgtaaaaatcactccagtaagcccaaatgttttcaatctgtggattggattgtttgcactggaaatgtagatttccaactgattttctactgatc

SEQ ID NO: 341196 - DNA, 133 bp, Homo sapiens
tctgagggctagcagaggggggaaaatgagcctacagggcagactgggaaggaacagaaaggtgtgagaaaaatccagagtatgcagtgtttttagaaacccaagaaaagtgcttcaggcaggagaatgtggt

SEQ ID NO: 341197 - DNA, 427 bp, Homo sapiens
aacattttttttcatttggctgtgtggtctggagaacaccttcctaagccagcggagtgaagttccacgcactgaccagccccgagctcactggagcgagtcatcttccggctccatggcagcccagccccacccacaggcagctgcctgtcacccacgctggcatgttccctcatcctacccaggcagcgggaaaacctggctgcttctgggatcctactactctgtcctgtccacaagccttcagagtcttggattcctaccctcaaacatcaactttgtgatttatcttcttgaaaacaaccacaaaaacttaaaatcaaaactctctaagggagtttcgcacaacccttgaggaatagttaaatgcccacggtgaaaccgagcttgtaccccacggtccaggtaggggcacattcctgaagtc

SEQ ID NO: 341198 - DNA, 299 bp, Homo sapiens
taattatagtgttgatgatattattgataacattcttgttatatgtcagacactgtgcatatatggtataaattttatcttctcagcaaccccattttatagaggaggaaattgtgtttctgatcagtttaagcaacttgctcaagggctgtcacagctggtaatcagcaggtctggctctgtctcagatatgtcctgctccagtgcctgtgctcttaactacttgtcttaatctaccttccacttttataggtgggaaatgtggaataaaaaaataactctatcgataattgtaattg

SEQ ID NO: 341199 - DNA, 692 bp, Homo sapiens
aaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcgcttccagtcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttctggtgagccgagatcatgccactgcactccagcctggggaagagactctagactccatcaaaaaataat

SEQ ID NO: 341200 - DNA, 499 bp, Homo sapiens
ttttttttttttttttttgagacggagtctcgctctgtcgcccaggctggagtgcagtggcgcgatctcggctcatgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttctggtgagccgagatcatgccactgcactccagcctggggaagagactctagactccatcaaaaaataat

SEQ ID NO: 341201 - DNA, 585 bp, Homo sapiens
cacgaaggggtgtcccagagtgtatttctactttctcatttctactgacagaatgttgatttttttttccttaacagctattaacacctagagtaatgaccattatttccgcaacctgtcttatggctaaagtgtggctatgcaatttaaattctagcccatttatataaatgcgggtttgaaatttttttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttctggtgagccgagatcatgccactgcactccagcctggggaagagactctagactccatcaaaaaataat

SEQ ID NO: 341202 - DNA, 344 bp, Homo sapiens
catagagtcttaatcctttagatagtgttgttctgatttaaatctggaaacttcaatttgatgaatcattacaaataggtttcctttcagcatttgattgatggagactgccagaaacactaagctaagaagggttccgaggccgtgcctgtgctcagctggaaagttttctgtgattgatgaatgatgtctggcattaggcttcccccaacctaaggttttgtataacaagaaatccaatttgagttgtccgttgattatagtaagccgaatctatgtctctggacaatgtgtgctataagtcatagagtgacctatgataactcagttaaatgaatatttat

SEQ ID NO: 341203 - DNA, 1163 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgtgagtgcgggccctcggctaggccgctgagtagtccagcctcgcgctgccctgg

SEQ ID NO: 341204 - DNA, 1883 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcaaaaaaaaaacgaaacacaaaaacacaccacaagaacacaaacacaaacaacaaaccaaccaccccacaaagaaaaccccacaaccccccaac

SEQ ID NO: 341205 - DNA, 1872 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgagtgagcaggggcgggcgagggtgggcgagggcggctgagcggctccatcccccggcctgctcatccccctcgccctctcagaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341206 - DNA, 1112 bp, Homo sapiens
gcctggccaccgaattaggggctgccctgtgtggcaccatcccaccctccccagcagtgcccctgtgctggtgggactccatcccagctcctgagggccccaggaggatgtccctccccaccccttagggcgtgggccccaggttctgggaggaaaggggttaggaggaaatgggccgaagggcttcccagagggattggcagcttgtgtggttgggggccgctgagggcagcacggagcctggggacctgggttcctggctcagggagagctgtggcttctcatgggcctcgcaggcgtgtactgttaccgtgtcaaccggcgcctgttcccggtgcctgtggatcccggtaccccctgccgcctgtgcaggacaccgcgagaccagcagggccctgggaccctggcgcagccagcgcacgtcaggtgagtgaccagagtattgggacaccttgggggacagagcctgaaccactggttttaagaaaagatgggcctgggcgtgggcccccaaccgctgggaggctcctcaggggtcccccactgcccccctgcgcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341207 - DNA, 979 bp, Homo sapiens
gcctggccaccgaattaggggctgccctgtgtggcaccatcccaccctccccagcagtgcccctgtgctggtgggactccatcccagctcctgagggccccaggaggatgtccctccccaccccttagggcgtgggccccaggttctgggaggaaaggggttaggaggaaatgggccgaagggcttcccagagggattggcagcttgtgtggttgggggccgctgagggcagcacggagcctggggacctgggttcctggctcagggagagctgtggcttctcatgggcctcgcaggcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341208 - DNA, 892 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341209 - DNA, 434 bp, Homo sapiens
tgctccacccaggaaggccaccctgactgcaagatccaggagggaatgtggctggaactggggatgacctgtccctttcaagtggcccccctgagacttccctattccccatccaggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341210 - DNA, 1791 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341211 - DNA, 1924 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcaggtgagtgaccagagtattgggacaccttgggggacagagcctgaaccactggttttaagaaaagatgggcctgggcgtgggcccccaaccgctgggaggctcctcaggggtcccccactgcccccctgcgcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341212 - DNA, 1595 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccggtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctgagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341213 - DNA, 682 bp, Homo sapiens
actgaaactgccgctgctgaactcagcgtatccagtcccgcagctgaccaatcggagctcgcccttccggggcccgccccattccaggaatcgacctccgcaccggcctcgaaaattgaccaatcggttgtgtagctccgctcttagtcccgcccccacgctgaaactgacacttcggatcgccgagtaacgctcaccagacgtcccggccctgcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagagccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgca

SEQ ID NO: 341214 - DNA, 630 bp, Homo sapiens
cccacttccagacaggtaccctaagcacccaagtgctgccattctcaccccatcactcctatttccttgtctctatagcatgattatttggtattccttatctattcatttgcttacttgtttgaggcatgtctcaccaactgctggtaaagtccatgacagcagtgactttctcagtcttgttcattacctgtacattacagtattgaccagagccaagcatatgccttctaggaatgcgcactctatacatatttactgaacatgaatacatttcttagtgaaaacacatgtagaaatctaaatgcaaaagcagagttggaaagtagctggatccaaaatacgtgttaaaagtttacactgggggccagaagcattggctcatgcctgtaatttcagctacttaggaggttgaggcaggaagactacttgaggccaagagttcaagatcagctggggcaacatagcaagatgctgcctcttaaaaaataattttaaaaactgtttaaagtttacactgggaaagaaagaggaagctcacttcattaaaagaggaagaaaataacagaaattaggtgattagtaaatgatgaagttccttggggacagctcctacagtgatcttatttc

SEQ ID NO: 341215 - DNA, 499 bp, Homo sapiens
agtctcaggaataaatattaggaaataaatccagacaatggattccaatcattagagatgtgaaatgaaggggtatttagaatgctatatacacagtaaagcttcctaaattgagatgcctgtatattttcttttataatgagggagaaggagttactcaggaacaagaggaacctgaggatagtagagagggagagtaaatgaagaaagaatattctgaaagagagcatgaagtcaagactaaggatcatcagtaaacaatggacacctgcctgtttcggcacttctgtagctttagtccttcaattcctttaatttcatcaaggacccttcagctggccaatatcaggcacatttcacacatgaagaaaatgaggcttagagaagctaagtatcttgctccaagtctcaggaagcagaacaaacacatgtgtatctaaaacaggagctgttagactctgaagttcacactttctctgagatgagacactgtcactca

SEQ ID NO: 341216 - DNA, 776 bp, Homo sapiens
cgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtggctccacagaggctgtgcactcaggtctggcccgcacatccgtactggccgggtaccg

SEQ ID NO: 341217 - DNA, 988 bp, Homo sapiens
cgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtggctccacagaggctgtgcactcaggtctggcccggcaggtgtccagccttctcactaaccatcttgcccgagccacagagtgctgtggcaaccaggctgctgggaatgacgcgctccaggatgtccttagtcttctcaatgatctctcaaggagccacataggtaaagccatcctgagccagccagcttgtgtgtccaaactcctctccctgctgcttgaccaacgcccgtctccaaagctagtccttattattctccagctgtgccggg

SEQ ID NO: 341218 - DNA, 542 bp, Homo sapiens
  misc_feature (95)..(95): n is a, c, g, or t
aactgcatagcccacgtaacaatcataaaaatgagaatttaaggccctggaggagactgagttagccaggtcctaggcggactcctttcatagcngttgcttcatatacatttagaaaaacacatgcgtggccaggtgcagtggctcacatctgtaatcccagcactttgggaggccaagaagaaccttatcaacctgcctgccctgtcttcttctctcagcataatcgcttcctctgagaaaccttccctgaatggccaccctatttctccaaaagcacttgccattgttggaattctatctttgtctgttcaggtgattaatatctatctctccaaatatcagagaccaatcctgttatgctcatcactgtattcccagaacagtgtctggtgtatcatatggctcaacagaaatgtgttgaatgaatgaataaatggactgaactgcatagcccactgtaacaatcataaaaatgagaatttaaggcccttggaggagactgagttagccaggtcctaggcggactcctttcatagctg

SEQ ID NO: 341219 - DNA, 548 bp, Homo sapiens
tggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccccatagtaacagcaaggcaaaaatctttaatagaagcacagaacaaaaattttaaaaga

SEQ ID NO: 341220 - DNA, 690 bp, Homo sapiens
  misc_feature (422)..(422): n is a, c, g, or t
  misc_feature (461)..(461): n is a, c, g, or t
  misc_feature (584)..(584): n is a, c, g, or t
  misc_feature (587)..(587): n is a, c, g, or t
  misc_feature (593)..(593): n is a, c, g, or t
  misc_feature (597)..(597): n is a, c, g, or t
  misc_feature (606)..(606): n is a, c, g, or t
  misc_feature (632)..(632): n is a, c, g, or t
ctctcctgcagaaacgaagggaaaagaactggcagaacctaaatgcttttaaactaggttgaacaaagagaggcaatggtggaaaagttaccaaattatatggggaggctaaaggaagacaagaatcatgttacccaggtctgtttgtacagaattctctcagctctgacaacatgtggtttttttcttctggtacccggagagcatctttcacatgggagtttttatcgcttgttttcaggaagaaaagaggaagattagaatgtccttcttgcatcaagcgcctttacctcaaaataatcctaagccaaagtggcttattttggaatggcatattctgccaccccttaactgtaactgggggcatttgaagttttcttgcacactgattattcacaaatactctaacaacatagagaatnccgaggagcaccaccaatacatgtattggtggtgctctncttcctttcaatgactgcctgctcattttcccaggcagtcaggagcaccgtcttttgaattccccgcaacgatgtatccatcaatccgggatgggggagtagcccccatgggaaataaagccnggngatggnctgnacacagtcnatgttcaactttgcgggcacgccggngtaaaatggggccagggttaactggacacagaccataggcattatgctggcaggaaaa

SEQ ID NO: 341221 - DNA, 507 bp, Homo sapiens
gggaatgaatgttggataggtaactaacagtgaactctgtcgtaaagttgctgaggattgccttaccatgtgtgcacacgtgtgtgtaagtcttttcaatgctcctattgctgtgacttcatctctagtacaggaaggattctgtcacatgacgtcatgacaggttttgagatacagtggaattaactgagtttcttgatctgctgatgacagaaaaaggagacaaggatgaggaagtcttgtgtgagtttttctttttttgcggggggtagggtgtctcactccttttgcccaggcttgagtgcagtggggtggtcacagctcactgcagcctcaattctctgggctcaggtgatcctccccccatcagtctcccaagtagctgggactgcaggcatgagctactggtacccagctgtcagatagtgaacttctgtccatccggcagccagacaatgagagagtccagcacagtagcgcctctgaagaaatacactgcttgccaaa

SEQ ID NO: 341222 - DNA, 696 bp, Homo sapiens
gggaatgaatgttggataggtaactaacagtgaactctgtcgtaaagttgctgaggattgccttaccatgtgtgcacacgtgtgtgtaagtcttttcaatgctcctattgctgtgacttcatctctagtacaggaaggattctgtcacatgacgtcatgacaggttttgagatacagtggaattaactgagtttcttgatctgctgatgacagaaaaaggagacaaggatgaggaagtcttgtgtgagtttttctttttttgcggggggtagggtgtctcactccttttgcccaggcttgagtgcagtggggtggtcacagctcactgcagcctcaattctctgggctcaggtgatcctccccccatcagtctcccaagtagctgggactgcaggagtgcatcaccatacccagctaattttttatatttttagtagagatggggcctcgctatgttgccctggctggtcttgaactcctgggctgaagcaatccgcccacctcggctttgcagagtgttgggattacaggtgtgagtcaccatgcccagcaatgagtttttgtttttgttttttgtttttcttaaacaaggcttttcttttatctttaaacactttgttggttctctctgtttggtagttgtactatgtctaagttgtttattttgttaggagcattttgttgtaatcatgaaat

SEQ ID NO: 341223 - DNA, 263 bp, Homo sapiens
tctgtcacaaaaaaaaaagcgttaagttaaggagcgtgaataaaaataatacatttcatattctaagacaatatcatctacaactttattccaatataaattactaaaactttaccatataagtagtagaaagcctgaatagataaaagctatggaagaaaaattaaagatagtgatagatttatcaccaagctcagatggttctgcaaacaaattctaagaaaccgtcagggaacagatcattactgcgttgacacagaagg

SEQ ID NO: 341224 - DNA, 314 bp, Homo sapiens
caaaattgagcaaatatttaaaagtaaaaccaacaaaaccaaaaacctatgccactattattgtttcctttatgtcattaaattgttttggttttatagtgtcatctgttcagtctacaatgcttctatgtcacatcaagtaatagtagcagaatattaggaggagtggttattcagttttagtttcaaagcttagaagagaagacgctgcattgtactgcaggtcagtatcaaggagatcaggttgagtcaagagtacaataatagaaaaggctggtggaattgaggatccgaattgtagggctctctgtagg

SEQ ID NO: 341225 - DNA, 181 bp, Homo sapiens
ttttcagttagacaaaatggcttaggaagcaggtactaaagggtcagacttccaccaatgcctgatggtctcaaggtactccagtcaagtgtgggaggagctgggggagacctatctttaaaaattgtggtgtgcctcttggctcattgctgactcaaatcatataaacaaaaaacaaact

SEQ ID NO: 341226 - DNA, 462 bp, Homo sapiens
ttcaaaaaatacagaagaaaaatttgccccccatctaagcccagaccttcaaactacttctcaataggtgatgcaaactgatggtttgataagatgatgatttccttttaatgaatccctggaaggatatcgagttgcaggtgaggatggaaaaatttataccttaccaaagccccactacaagtctttcatgtaggagcattaaattcactcatgccacaaaatgtactgaaggcctactattgccaggcattctgctgggctatagtaaacaaagcagacaaacacacctgctcgcagcagaaaataaacaataaacataacatataagtaaatcatatagtatgttacagggtgataagcgttgtgactaaagggaaacatagggcaggataagggaggtcaggaggttgagtgttggaagtacatttaaataggatgatcaggaaaagcctcactgaa

SEQ ID NO: 341227 - DNA, 339 bp, Homo sapiens
taccattgaagtcttctggaagcagaagggtctggggagctgccagctccctgctggcgggggtgtccttttgaggcctgatggagacaggcttaggtgtggggttgactcagtgtccctggacttgcccctttggacctgggcctgtgggtgtggttcttggctcaggccttttaaactctgctcttacagtttctctggtggtgaaaagctaaactctgtgttagtgtgttttcacgctgctgataaagacatacctgagactggcgctttacaaacaaaagcggtttaatggactcacagttccacatggctggggaggcctcacaatcatggcgg

SEQ ID NO: 341228 - DNA, 97 bp, Homo sapiens
ggcttctgcagcgagaggctggagctggcactgggaacactacccctcatggtcaagagcaccagcgcccctgggggctgcaacctctgccctcccg

SEQ ID NO: 341229 - DNA, 359 bp, Homo sapiens
gagaattgcttgaacccaggaggtggaggttgcggtgagccggagatcgcgccattgcactccagcctgggcaataagagcgaaacgccgtctcaaaaaaaaggaaagaaagaaagaaaagaaaaggccggacgcagtggctcacgcctataatcccagcacttcaggagtccaaggcgggcggatcacgaggtcaagagtttgagaccagcctggccaacacagcaaaactgcgtctctactaaaaatacaaaaattggccgggtgcggtggttcacacctgtaattccagcactttgggaggccaaggcaggcggatcacttgaggtcaagagttcaagactagcctggccaacatg

SEQ ID NO: 341230 - DNA, 649 bp, Homo sapiens
gagctgcattgaggtttttgaaatcgttctggtgggtggtgatgaaatcctgaacacaggcggtgtcaatgcaggagacagaagaggccagatgtcttctcgagtcctaaaactatagaatgtatttcattactttcctttcatttgctcttcaacctgtagccctcaactcttgcaagactccaataatcattatttaaggattcgagttatggagaaattcacctggcacacaagaggtgggtcaggaagctcagttaatgagtctgagagagaaagaaaagaattgccaagtttcaggcagtgagctggagacagtctgtactttttgggaactccaaaaggaagtgtgttgacttggctgacatttcagcggggaaaataaggaaggaaggtgatgggtgactgtgaggccagaggcctttgccttttccgtacaccagctccacagtgagcatcctgagggcaggaaccatatctgacacatctctgaatcctaccacccttagctcgtgcaggcatttgaaaggtgctgtaagcgaggggaatgttggagtccattctgactctgctcacaggattgggagccacgctaacccgacaacctctgaactctggatatggaaccaggccgaggctgccagctctt

SEQ ID NO: 341231 - DNA, 160 bp, Homo sapiens
tctaatatttaaaacaaaacataaaatgacattaaagaagtttgtgccatttatttttacaactcaccgaattgactgttttacgaattttattacccaaaactctactgacttgaatgcaagaaaggtcatgtttgaatcagtaaagcccagactgcag

SEQ ID NO: 341232 - DNA, 196 bp, Homo sapiens
ctgcacttgtatgtttattgcaacattattcacaataaaatatatgtaatcaatttaaatgtccatcaaaggatgactgcataaggaaaatctggtgtgcatgtgcgtgtgcatatgtgtgtgtgtgtgtgtgtgtgtgtgtgtatgtgtacatacgctactcagccattaaaaagaacgaaatcatttgccacaa

SEQ ID NO: 341233 - DNA, 170 bp, Homo sapiens
tggataatgaagaaaatattaaaaagaattctatgtcaggaaagttcgaaaaaacggggaatatttagcctgatcaataaaacatttataggggatgcaaaagttgtttttaaactcctaaaagtatgtgtttgaaaaagggattaaatttattttttgagactccaagt

SEQ ID NO: 341234 - DNA, 226 bp, Homo sapiens
cagagtgtctggggtccctttgtgggggaccactaggcttctagagtctgaccctgcccacaggtgggtcagagcctgaatcctggttttatagagttagatcagacctcttaaggcttggaggtcaagagggagagcaattgaagaggaccttgggaggtgggagctctcaccagcccaagtgatgatcacctcccagctcaaatcagagcagctgaaatctgcc

SEQ ID NO: 341235 - DNA, 331 bp, Homo sapiens
aatgtgcccaacaccccatggtttatggcagaagagctcaggctagaacttggagatctgagctgtttctctgcagcagccccaattccccgcctagaaatgtaatggaagaaggatacgagagatttgatgttccatttttttagaactctctcaaataatggaaaaagatacttcctatttaactgcataataatcccgggatgtgactaggagggaggaaagaatggagagagagagagagagagagagagagagagagagagagaaatagttagttaggtggatagtctcacttacttctgaaagtttattgtgaatatgactgtgt

SEQ ID NO: 341236 - DNA, 575 bp, Homo sapiens
tgagggcaggtggcatggggtcctggaatgctgctagctgcttgtgtcaattacatgggtcacaacttgattcccttccgctggaaactgtaagaaaaggggaacggcacacagaaaatgaagagccagacaccagacggcaagagaactggggaaaagaaatcaagttttactcctaactaggtaagtagccttgagcaggccaatttccctctgtggatttctaataccagggatttaactaaaagatgtccaaggaccactctagccatgaccttccagaaatcactctattaccaaatcatgtgagcaaatgtaggtctgagaaatgggagagagctacatgagggagaagaaaatgaaggtattaaatgggattcaagttaatattggccaaaagacagaagatggcagagagcaaaggaagggagcctgaaccagaacgttcccaatcctggcctggctcataacttgctgtgtgatcctggctacatgccaacttcatttcctcatcagcccaatggacctcggggccctatgttctggcctcagctgcccactctccaaccttatct

SEQ ID NO: 341237 - DNA, 440 bp, Homo sapiens
aggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccc

SEQ ID NO: 341238 - DNA, 591 bp, Homo sapiens
ctggaattcggcacgagcatctctccaactaaagtcctataacattccaacccattgccttgagttctccttggttgatctcctgggtgtcccaactctcagatagtcctgtcacactcatggggctttattgcctagtttacatgggggtgcttctttcctgcctgctgcttccctctttgtgggtgaagatcagttgctataatggcctggcctttcttcctcttcccctttcactcaattcttctctttcagcccccaggaagacgcagtagcttctctccttggtaaatttgggaaaaataaactggatgtaaaaagatcagctttcacctctatagtttcactctccttttctatgctttcaaggctaaccagcctctctgaagactgctttaaatctttattctaatatgacaatatgttcagtcagctctcccagattttatataactgggagttgtctttttcagctcccctcagtgcctctctgctctgagttaaaatctgttgctttcaaagcttaattgtcagatgccattcattcaaaaaatactaatcagtgcaggtactgtcctgggtttgggaaat

SEQ ID NO: 341239 - DNA, 538 bp, Homo sapiens
ctggaattcggcacgagcatctctccaactaaagtcctataacattccaacccattgccttgagttctccttggttgatctcctgggtgtcccaactctcagatagtcctgtcacactcatggggctttattgcctagtttacatgggggtgcttctttcctgcctgctgcttccctctttgtgggtgaagatcagttgctataatggcctggcctttcttcctcttcccctttcactcaattcttctctttcagcccccaggaagacgcagtagcttctctccttggtaaatttgggaaaaataaactggatgtagctaaccagcctctctgaagactgctttaaatctttattctaatatgacaatatgttcagtcagctctcccagattttatataactgggagttgtctttttcagctcccctcagtgcctctctgctctgagttaaaatctgttgctttcaaagcttaattgtcagatgccattcattcaaaaaatactaatcagtgcaggtactgtcctgggtttgggaaat

SEQ ID NO: 341240 - DNA, 327 bp, Homo sapiens
ttatagtaccaggattgcgtagatcattatatgctctataccattatttgccactaacctggtgacttaagagtacgatagctgtcgttcagatttattaacctttcttcgtatgtttgaaagtcattatgagtgtactggcttaagctaatagcagattagtaaatattgaaagagtcatcttgccatttgaagtgttttctggctagaataaatgtttgttcaggttgtagccctgcccaggtaatcaccaggtaaaaatacaggatcaacttccagtgctggaacaagcaggataaattactaggtgcaggaatgggttttatg

SEQ ID NO: 341241 - DNA, 613 bp, Homo sapiens
ggttacaaggctggtcaccagcagtgagggtgccgctgaggtgggatagcttacacggaaagaacagtcatgtttggtggtttttctagagcaacatcagcagttggtatctggaggaggagtaatgaatggtgggaggacagtgaaaaagggaaactgtcttctaagtggagtgtctgagcaggacatccatgccagggggaaaagatatgagggagtcacaaagagtaggtagactgagaaagggaggaatttaggggctagaggtgacaatgaggacagagagtgattgtgcatatcagtaagaatggaattaggtttggtctagggcgaggagtagatcaatatgtaaatgttttggaaactaaaacaccagataaaaattaccattcctaatctacagctaaaatgtggttccctgttcttaatagatgatattttccctgatcattgttaatttcaacaatattttcttctcttcttgtttggctgaaacatcctgaggttttccactctctcatgttctaaggtcagacttctgaatcctctcattttagtctaggtcagtgatcttcaaccttggctgtgtactggactcacctgaggagattaa

SEQ ID NO: 341242 - DNA, 335 bp, Homo sapiens
tcatcgtttctgtctctctttgctacattctggaaactttcctcaatctctttttcattcagttattttctctttagctttgtcttacctgatgtttgtcctcacctttgagtttttaattccaatgactatatttttcatttgtgtttccatttgctactcttcaaatccaccttttcatcgtgttctattattttgttagaactttaattattttatgtttaatcatttttaacttattttgtagtgtctcccaaattattgtagtaagttcaggggtggaaattctgtttcagaacatactaatctttacaatggtggctgtatgcgtatgt

SEQ ID NO: 341243 - DNA, 184 bp, Homo sapiens
aggaaggcacttaatagggaaaactgacacaaaaagtaacggggaaaaaaagactacggggggaaggaaacttcaaaaataataatcattaatatcctagagagaacagaggtccttaaaagaagagcaggatattattttttaaagaggacaacaccaacaaaaaggcagtggcagtgcaaga

SEQ ID NO: 341244 - DNA, 415 bp, Homo sapiens
ctgaccgcccttgatttttaaaaatttaatgcagcagacatactgagcatatgctgtgtgtaaaacattttacctggcgctggcccacgtgcgtggaagatctataaagtcccgctttttatggagcttatgacattagggagtgagagggagtgcacaagtataaataactaatagacaaaacataacaaatctaggtataaaagtgctatataacaggaagcaaaaaggaaataaggataatagcattcctcctttgtcagctcaaaatttctggttaacctgttgagtaaacttaaatacctgcctttgcagccatagtagaggtcagtacacacacgggtctctcctgttttccctcttctgatttcttttttttttttttttttagtttttattgatcattcttgggtgt

SEQ ID NO: 341245 - DNA, 909 bp, Homo sapiens
aacacaaatagcagagaagaaggggatgcaacctggagcagatcaaatgctgcatcccagtggactaggagatcctcagtgacatgctcttcaagccacactgactcagaatcatccatttttaactctaggacctcaaagcatccttgaaccactttacaataaacagcaagtaatttaggtcatctgagtcaagagaacaatgccatccagggtataccaaaatatcaagccctactgtcaaaaggaccagaaaataaagtacaggtggagaggaagtgatttcacccgctggaaatagaaaaagtagatctgtgtgtcagccaacaactatcacacaatggaacaggatgcttacctctctgctggaggaaaagaagctattctcaagtccttagaataaaaactattgtaatcttactatatctattttatgtcatctgagagcaatccatgaggacaatgcttcctctttcagagaatcttccaactgaaaatctcaaagaattcccaagcaccacttgcccttcaacacctacctacacctcacttctctgccccacactcacaaactttattagcatccacaattaaagaaccatgaggccaggcgcggtagctcatgtctgtaatcgcagcactctgggaggccaaggtagaagaatcacttgagcccagagggttgagaccagcctgggcaacatagggagaccttgtctgtacaaaaaaaaaaaattctcggccaggcacggtggctcacacatgcaatcccagcactttcagagcccaaggcaggcggatcacaagctcaagagatcaagaccattctggccaacatggtgaaaccccgtctctactaaaaatacaaaaattagctgggcatggtggcacacacctgttgtcccagct

SEQ ID NO: 341246 - DNA, 562 bp, Homo sapiens
tcagtcgacgcaaacagtcacagctacgatgtggagatgcaagtccagaatgattcctatgtcatcaactccgaacgtctaggaccaaaggagagcaggccccagtgctgtgcgtcctacgagcaccacctgctgtctcacctcttccaggaagcccaccctgatccctctagtcccagcctcagacactgaagcaacatcaggcggatgtcacccaccccttgggacttcgccatgggtcgctagcccagaccctccccttggttccggtggttccatttctgcccctttgctgctggcccccttctgaggatgcccgtgcatctccaggaccactgctccagtccttggtgtagatcaaagctggccttcacacgcggcctgaaaatgtagagtggccgccttctgggctgggctgccacctccaccacatcacccgtgacagaagccccgtgtttttcggtaaccacgttccacgaacacctcccgactgccttccagaacacacaaagatcaacgaagctcagaatccagtcccgacgtcatttcatgaagagcaggt

SEQ ID NO: 341247 - DNA, 612 bp, Homo sapiens
cccgcccgagcccggagagcctgggctgcaggggagggcgccacaggtgaggacacagctccgtgggcaccaggcaaggtcccaaagcagatccgcagccggtcagaggagcgcacatggctccacgagatgtgactattcctatctgctggagaacagccgtccagggccaccccacgtccttcaaggggactctgagacactctgggccggtgggaccttcagcagcatctggactttggctgcctcacaggcggatgtcacccaccccttgggacttcgccatgggtcgctagcccagaccctccccttggttccggtggttccatttctgcccctttgctgctggcccccttctgaggatgcccgtgcatctccaggaccactgctccagtccttggtgtagatcaaagctggccttcacacgcggcctgaaaatgtagagtggccgccttctgggctgggctgccacctccaccacatcacccgtgacagaagccccgtgtttttcggtaaccacgttccacgaacacctcccgactgccttccagaacacacaaagatcaacgaagctcagaatccagtcccgacgtcatttcatgaagagcaggt

SEQ ID NO: 341248 - DNA, 1397 bp, Homo sapiens
tcaggcgaccggatgtaccagtggtggaagatcctgtccggctgcaccgaggctcacatcagaagccggcttcggtttcaccacaaaataaggcatctagcgcccgattctgcctccaaagcagccctgggtcacactcgctgtaggacagatgttattcttcagaatcacgccctctggcaaatgcccatcgtcggacaaatggacggatgaagtgtgactcagccatgagaagggggatgctctgagccgcgcggccacaccaccaacccggaggacacggtgctgcgaggaaaagccagccaggagttcagaagtaacagggcaaatagggaaagtccttcctggcctgtctacatacccctgcagccctcccggtcctagggtgactgctgacggagagggcactcccttcccgagtcttctctgcacgtccgtgggcacgcacagctgagcggcacacagcagcccggctcgctcctccgcactggggacacaagatttcactgcacctcacccagccctttccacagagcagttcatcttggagactcttcccctcgaagggtctaaaggccagtctccgtgtcctggtgtttgttgtcggggaggatgcaacatcgggggaaggaagtaatcatgtctggtggcagctggcactggcaggcagcgggcactcgaagcctgcacctcgcacctgtccctctggggcctcggctatccctccgcacgacgggcatgaagccccctcctgcctccactgctcggatgaaaggagctcgtagatgacggagttgatgacataggaatcattctggacttgcatctccacatcgtagctgtgactgtttgccacagcgaggaagatcctctccccgatctggaagacctcccagtctgcagcaccgaacgtctaggaccaaaggagagcaggccccagtgctgtgcgtcctacgagcaccacctgctgtctcacctcttccaggaagcccaccctgatccctctagtcccagcctcagacactgaagcaacatcaggcggatgtcacccaccccttgggacttcgccatgggtcgctagcccagaccctccccttggttccggtggttccatttctgcccctttgctgctggcccccttctgaggatgcccgtgcatctccaggaccactgctccagtccttggtgtagatcaaagctggccttcacacgcggcctgaaaatgtagagtggccgccttctgggctgggctgccacctccaccacatcacccgtgacagaagccccgtgtttttcggtaaccacgttccacgaacacctcccgactgccttccagaacacacaaagatcaacgaagctcagaatccagtcccgacgtcatttcatgaagagcaggt

SEQ ID NO: 341249 - DNA, 388 bp, Homo sapiens
aaacagtaaacaaattaagacatctctaggacctaaaaggatttcaacacaatgtgagaaatgttggcaaaacatgaaagtgggctttgtgagttttgaggaattactgagttttgaaagatgaggctcaggccaggtggagaggaagcccgtccatgtgtgcgtggtcccagcgccttcccagggccctcctaaggcaccttcagggcctgggccatgatggcgcccccagcagccaggtccccgttcccggagttctggttctgctttgggagctgcagccgtgcttccttctgtctgctgtggtcctgctctagcccctgctcttctctgatgtttctttcaggcggatgtcacccaccccttgggacttcgccatgggtcgcta

SEQ ID NO: 341250 - DNA, 356 bp, Homo sapiens
cacacgcggcctgaaaatgtagagtggccgccttctgggctgggctgccacctccaccacatcacccgtgacagaagccccgtgtttttcggtaaccacgttccacgaacacctcccgactgccttccagaacacacaaagatcaacgaagctcagaatccagtcccgacgtcatttcatgaagagcaggtagtccatcaaagggatgggccccatgagtgaagggctgagaccccaccatggtgtgaggcgtcccaggcactcccgtcacggcccaaaccaggctgcaggctccatccccatggggcaggcacagaggaggcgattcatgtggacacagggacacctgtggacgc

SEQ ID NO: 341251 - DNA, 284 bp, Homo sapiens
cacagaccggaattccaccccagaggacgccccacactggtcaggatggttgtggattctcagtgcccactgtccaaaatgtggtgcccacgcaacctcctgtggctccacggagcgtgtcggtctggaaccatcactttctcgtacatacagacccaccctccatgttccctggatctcacatctgtctcaacaggccagtctccgtgtcctggtgtttgttgtcggggaggatgcaacatcgggggaaggaagtaatcatgtctggtggcagctggcactgg

SEQ ID NO: 341252 - DNA, 498 bp, Homo sapiens
ctctcatgcgatcctggtatcctaagtgccccatcagagttagctgtgctgccgctgccactcctgctataccaaagacctaaccagtcctgtggaaatgcagatgagagagaatacctgtgttcagggaagtggttggagtttatccttgaagaatcaccaggtgacagcctccctggcatgggggacagtgtaggcaacagcacagaagtggagtgtagcagatgccaggaatctgagccaggcttcaagctggagatggatgaaggggtgatgggagacagagcccaacagcaagagggaaggagatggcaaagcacctgtgcatgttggggtgcagaggggccagctgggctcccacctgaggtgtgctgtggcaagaccactcgatgggggcagtgacccacagaagctgcccgattctgctctggagtccgagtccctggcttagattcttggtctctttttccatctgtctgtccatctctctgttcctgc

SEQ ID NO: 341253 - DNA, 289 bp, Homo sapiens
tctctattctttcctctatgttgtttcacattataattcatttcttggttagctgcagtactattttaagcagttctttgttaaaaggaaaggtatatcaatggtaaagtttgtgagattttgcaatgttagagaatgtgtttatgcttttttttttttttttgctcatgcatccaatcattctacaaatacagtcatgcatcgcttaacaacaggaacacattctgagaaatgcaaccttaagcaatttaatcactctgtgaacacagagtatacttacacacaaatt

SEQ ID NO: 341254 - DNA, 549 bp, Homo sapiens
actcaaaagcacagacagaaaagatttgctaaccaccaatatttattttgcttaaccatacctgccaacctagccaaaatattctttggatataatcgttgttcttcatcattgtctgtaaattaaaagactaatctcaggaaatctataaacttagatatcagaaacatagtcaccggtaaattttaaatcaggataccagtatgttaaacctttaactcaatctcatcaaggtaatttttaagttatagtaaaaagacactgctagcctcatttaccaatcagtgactaaaatttatctggtttttttttttatttttaatttggtatccggaagaacttacatacccaaatagagtacaaagtaattaactttcaggtgcccaccacaagcttcaaaaattactaacatttggctatccttaacagttaatttcaaggtggacaatacagagaacttatgaaaataagtaacaggtgagtgtatctcaaatttgacgtccacgcttctacaattttcctcttgccagcgtgtccctttcatgtggt

SEQ ID NO: 341255 - DNA, 203 bp, Homo sapiens
gctccactcttcccctctcacttgcctctgcctccatccccccttaagcttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttacc

SEQ ID NO: 341256 - DNA, 300 bp, Homo sapiens
acctgtaggaaatttgtatgtcttcttttgagaaatgtatattcatattttttgcccatttttaatgagattattttttgtatttgttgaattgagtttcttgtagattctggatattagtctcctcctgttggatgaatagtttgcaaaaatgttctctcactatgcaggttttctattcaccctattgatcatctgttatactgtgcagaagttttttagtttaatttagtttaattataacccatttgtctttatttatttatttatttatttatttttttatacagagtctcactc

SEQ ID NO: 341257 - DNA, 1471 bp, Homo sapiens
accctcacctcgtgtcactcacacataactggatttttctattttttcaaaaatcattgggatgttgacaggggttgcactgaatctgtagaatactttggtagtactgacatctcacctaaattaagtcttccaatccatgaacatgagaaatctttccagttgtttatatattctttaatttctttcagtaatattttgtagttttcagtttacaaatcttctctttggttaagacaactcctaagtattttactctttttgatgctattgtaaatggaattactggccaggtgcggtggctcacacctgtaatcccagcactttgggaggccgaggcaggtggatcacgaggtcaggagttcaagaccaaactggccaacatggtgaaactctgtcgctactaaaaatacaaaaattagctcggcatagtggcatgagccgataatcccagctactcgagaggctgaggcaggagaatcgctcaaacccaggaggcagaggttgcagtgagccgagatcgtgccactgcactccagcctgggcgatagagcgagactctgtctcaaaaaattccagatcagaactctaggagaaaatgaatttcccaccacctgtctatcaatcaaatacttactgaatgactatcatattgccaacactatgctaggcactaaagatacaaagatcaaaatactgaatccctaccttcaaagagctcatcatctaaggtggtaacatgcaacacatggggcattagggaatatgtactgtgctccaggtcagggttaaggtagtaaggaagacatcaggaaaggaagcagtaaccactgagttgaatcttaaaggatgaataggaggtagaggttataatgtgttgggcactgtgctaagtgttcaagctacaaagattaatcagaggaagtctctgcacatagttctgtaagggaaaaagccacataaaaaaacattttcaaaacaatgagattaaaagttttaagacagacatgttataaaaatagaggagaacaagctcagtagggaaggggaatagagcaaaggaaaagctacacaaagaaactcatgtctgaactgaatcatgaaggataagcagatattcaataggtgggcaacgcagggaggagggcattctaggcagggagaatagtatgagcattggaacaaaggtaccaagtgtgacttgagagagcccaatgtgattaggaacttgcatgtggcttagtttcactgaaatgtaggctatgaaacaaaaaagaggttagaagggaaataaagtaagaaaagtaaaaagaaatgttatgaactaaatcatgaagatactggtattctcatatggttactaaacctttatatttcttttttttctaaaaaaaaacttggctcaagtgttaaaaattttcttgttcatttatacttgattaaataaatatagtaacatttgtcattgcaa

SEQ ID NO: 341258 - DNA, 560 bp, Homo sapiens
aaaggcagaataagctctggtggcttaataaagattctggatttttttctaagtgccaaagaaaatctttaaagaatatttaaaagaatgacacagatttatgtcttttcctctgagcagaaagtggtaagatttgctcaaaagcaaggggtgggggataagcaactagatacagacagtgccattaactaacatgacagagtgaggaaaaacattttgtggcagtgttgtttaggggggaattcagaagcttttgggcatgatacttttgggatgcctgtgagacagccaagaggtacgttgagtagcagctggatgtcagtcaggggctggtagttaggaatattgatcaagttatttaaacttacctagaatgtttataaaatacaaatcaataggccacactccagatctaccgaataagaaagggcttgcacatcattaacattgtcaagtgattctgatgtcaactggaggagtctgggaaccacttacgtaataaattttaacgttcttttttttcttttttctttttttttttgagacagagtctcgctctg

SEQ ID NO: 341259 - DNA, 132 bp, Homo sapiens
tctcaacaacaacaacaacaaaaaaaaaaaaaaaaagaagaaaaagaataacatttttagagcatttgctgtatgccaagaactgctgtaaatgctaccatgtcttaattcattcagttctttgccactcca

SEQ ID NO: 341260 - DNA, 329 bp, Homo sapiens
acattcaatctaggagccaaatctagaatacaaccccatttacaatagccacaaaaaagtacctaagattatatctaaccaaggaagtaaaagatctctacaaggagaaacacaaaacactgctaaaagaaatcacagataacacaaacaaattgaaaaatattttatgttcattcactggaagaatcaatatcatgaatatcatcatactgcccaccaccaatgtcattctttacagtattggaaataactattctaaaattcatatggaaacaaaaaagagcctgagtggccaaagcaatcctaagcaaaaagaacaaagttggagg

SEQ ID NO: 341261 - DNA, 300 bp, Homo sapiens
agccaggctggtctcgaactcctggcctcaagtgatccacctgcctccgtctcccaaagtgctggaattacaggtgtgagccactgcacctggcccccattggactttttctctaactgatttgtacttgtatcaagttctggtgagtccgtgagataatatggccattctatccctgtggacactgaagctcagagaggttgtgtcccttgctcagcatcactcagttgtaagtgctaggactgggatccagagccctcacttttttgtttttggttttttgcttttttgagtcagggt

SEQ ID NO: 341262 - DNA, 816 bp, Homo sapiens
  misc_feature (737)..(737): n is a, c, g, or t
  misc_feature (759)..(759): n is a, c, g, or t
  misc_feature (792)..(792): n is a, c, g, or t
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccagacctattaccgaanggccaaggggggggaaaaaaanccttggggaaaaaaaaaaatttggggggggggnggggggaaaaaaaccccaaagggg

SEQ ID NO: 341263 - DNA, 502 bp, Homo sapiens
gatagagcaattctaaataaatatgcacccaaagctaggccacccagattcattaagcagattcctgctatacttaagaaaccagatagtaatacaataatagtggataggggacttcagccccccgctgacagcgctaaatgggtcatcaagacagagagtctgcaaagaacgactgggctttaggtggactttagaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341264 - DNA, 2951 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341265 - DNA, 2792 bp, Homo sapiens
ccgaggctctgtacactgccatgaagggctttggcagtgacaaggaggccatactggacataatcacctcacggagcaacaggcagaggggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341266 - DNA, 2684 bp, Homo sapiens
ttgctctcccctattccaggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341267 - DNA, 2845 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagggtgacacctccggagacttcctgaaggccttgctggctctctgtggtggtgaggactagggccacagctttggcgggcacttctgccaagattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341268 - DNA, 2906 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341269 - DNA, 2749 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341270 - DNA, 2330 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaatgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341271 - DNA, 2500 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattggtaactggcagggactaagggaagggctgggggcactgggaacttgaacagattctctggaagaatagaaccttggcagcctccgaagctactactggaaagtaaacactgtcacagttcgcctccaggggtgctgccaaatgtgtgattgtgcaggaatgtcatgaggtctgtgcgaggctgcaggagagggtgagaaaataactgttgctagggaagaaccaggaagactggggcaggcaggggagggggcacgctgtcctgcacaactagggtgtatacacacacacaccacacacacacttgacacacacacctaacatatacaagacacatactatacacacacacattctcacatgtgacacacactcatacataaaacacgttacatatgcatgtgacaggtgcacaccacacatacacacatcacacacagaacacattatatatacacatacatgctacacccccacaagacactacacctacacacacaccactcacacactatgcacacatgacccatgcacaccacatata

SEQ ID NO: 341272 - DNA, 1988 bp, Homo sapiens
ggagggccagggctgctatgaataagtgttcattcagccttcccctctttcaggctgtgcagaaccttcacctccttgtctgagaggagcccagggctgggtgagaggtaacctttctttctttctcttcagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341273 - DNA, 1950 bp, Homo sapiens
gtgtccatcccccttcgtgtgtccatccccgttcgtgtgtccatcccccttcgtgtgtccatcccccttcgtgtgtccatcccccttcgtcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341274 - DNA, 2187 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341275 - DNA, 1348 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaaacgcatcttcttcggcgcccct

SEQ ID NO: 341276 - DNA, 1691 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggtaaacaagcacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341277 - DNA, 1317 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaaaaaa

SEQ ID NO: 341278 - DNA, 1152 bp, Homo sapiens
catatgatgcgtaccctaagtttatagaatctgccaatattatggatccggatgagcaattggaaacccttcatgaagcactgaaactactgccacctgctcactgcgaaaccctccggtacctcatggcacatttaaagagagtgaccctccacgaaaaggagaatcttatgaatgcagagaaccttggaatcgtctttggacccacccttataagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341279 - DNA, 1433 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggtaaacaagcacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtgggcgttgcaagttcgtgtcaataaccataatcaagtaaactatcaagagaagccgtgatatggaaagtgtgaaaaatgtatatgggctggctggagagaagaacggtgatccattactgtattacaacaggactctcgagggggatcacaaactcagagtcctaagtgatgcatgatcttgctgttcaccagcccgtcacagatacggaaccagtagtgagatcactgtcgtccagacacgagcgatatccgaatggcgcaacattcttaaggacggtcgacatcacgatacccagcagaccgcctctggatcaacccccctgcaactgcttcgggcgccctggtcggcaacccccaacgagtgcgcagagggtcctgctcgagctc

SEQ ID NO: 341280 - DNA, 759 bp, Homo sapiens
  misc_feature (161)..(161): n is a, c, g, or t
aatttgctggtatccgaagggccggaaaaagtactcggacccacgatgatttaaatacataaaaggatgggtgattccttaccgtatcaaatgtcttatttttcagttctgaagtggcatccatgtctttaaactctcctgcaatatgaactataccgtanactctgccgaattcggcacgagcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341281 - DNA, 730 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341282 - DNA, 631 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcggattttctggggaggcccagtggaatcaccagcctcaccccacccagcctctccgatatacttcctgggtggcgacaaagcacaggatgtggtctctaccgtgattcctgagcatgcatgcaccccttctcctgccaatagaggggaggaagtcggaggggtgtctttatgcctataaacttgccttggaatccagcctcactccctttcctcctggagttgagaagcccccacagagactggctatgggggagtgactgtctataggttccttggatgtcctgcctatctgcaaaatgagaatgagatcgataccttcatgaggctgtaagatggcagatataaaagtgctgtgttatctcaaaagggtgtggtgcttgagaaggcaggcgacctgagcctcaagttcctcttctgaaaaatccatgtcctggtggtccttaaataatagcaataaaatggtaaccactattacctct

SEQ ID NO: 341283 - DNA, 321 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagagtcagtctcattctgtcgcccaggctggaatgcagtgatgcgatctgagctcactacaacctctgcctcccaggttcaagtgattctcctgacccagcctcctgagtagctgagattacaggtgc

SEQ ID NO: 341284 - DNA, 136 bp, Homo sapiens
agagcattcagagaggtgaaaatgagcagggtgtgtggtggtacagagatggagatgggtcgatgtttggggactgaactttcttgctgctcctgctgcaggggcatcgtgaggagggaggagaaaacctggacca

SEQ ID NO: 341285 - DNA, 526 bp, Homo sapiens
atgtgcgtgacctcccagtcgcctccatcatagcaccagccctagcttcatggtggacagtcgtcctggccactgtgcccccctgctcttgaagtcctcatttcttctcgggggtacagaggcactctcaaacctccctgtctctctgtctgacgcagtgttcgatgagtatctgaagaccacagggaagccgattgaagccagcatccgaggggagctgtctggggactttgagaagctaatgctggccgtaggtatgtcctgacgttgcattcctgggggctttaggggattctggaacactggcctaggaacaaggggctgagaatggaaaggggaattacatggtatagaattgggaaggagaaaaccatgtgggccgtgaattctaaaggtttctccagggcagcatggctgaggctggggacgggaagggggtttgagcctcaggtactgacttcctccagctcccttctccaccactggcagggggacaaagagctctgaacttgggttgaggataatg

SEQ ID NO: 341286 - DNA, 442 bp, Homo sapiens
gtattgagctaggtggccctcaaggaatagaaacaaagagggagtcaggccatcccatcccccttctgaggcagccagaataactctacctcttcctccctcttcacagtgaagtgtatccggagcaccccggaatattttgctgaaaggctcttcaaggctatgaaggtgcgtggtggggctgatgtgaatggggtttggggagaggactattgggagtctttgacaagtccttgggatccagtggccaaagagagcccttcagggatggccacaggactgaccctggtgaaggtgctctgtcgcaggtgagctgtagagccaggaatgctgctggtcacatgtcctgccacctgcatacctgcctgacgtcatgagtcaacagatgaacttagggtggcagcctgcacctgatccctccagccaaatgggttggcggctc

SEQ ID NO: 341287 - DNA, 576 bp, Homo sapiens
  misc_feature (48)..(48): n is a, c, g, or t
  misc_feature (54)..(55): n is a, c, g, or t
tctagaggatccgcgtgtggttctgtctggggatgtcagggatgcatngtggcnnttgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatccttgccccaagtcaaaagaaattagagctgatcctctagagtgaccggtacca

SEQ ID NO: 341288 - DNA, 2808 bp, Homo sapiens
  misc_feature (2546)..(2548): n is a, c, g, or t
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgannntcgtgccgaattcgaggatcatctacaaggctgcggtagagcagtgacagaagagcagaaaatgagttcaaggcagccttcgacatcttcgtgcttggcgctgaggatggctgcatcacaccaaggagctgggcaaggtgatgaggatgctgggcagaaccccaccctgaggagctgcaggagatgatcgatgaggtggacgaggacggcacgcacgttggacttttataagtcctcgtataatggtcgtcataaggacg

SEQ ID NO: 341289 - DNA, 2770 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341290 - DNA, 2455 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341291 - DNA, 2199 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341292 - DNA, 1998 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctcccactaggtgtgtctgctatttccaagatctcagcagccacctggcatcttcccgtgcctgggtccggcta

SEQ ID NO: 341293 - DNA, 1738 bp, Homo sapiens
tctttctgacctcttctcccctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341294 - DNA, 1804 bp, Homo sapiens
ttcactcacacagagaccaaactgctagttaacactgtgaggcatgtgcgtgtccttctgttctcttccaatacttacaagtagaaatttctattcagatgttcatgtgtatatgtggtgttatacacacacgcctatataccttttctgtttggggggctggaaggcaaagcagttcacatgggaggttctggggatcttgagaggctggcatagtcagccttggttgtgccaaggtcttgggcctgagggccatgtctggaggtgaggagaaaatccaggaatgcttggcctgagctttagccgtccgggccccatggacctctgcacaggaggtcagaactatggctgagatcatctttgccttgacattccagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341295 - DNA, 1351 bp, Homo sapiens
  misc_feature (1332)..(1332): n is a, c, g, or t
  misc_feature (1337)..(1337): n is a, c, g, or t
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacntgcanccagaggacacttt

SEQ ID NO: 341296 - DNA, 1052 bp, Homo sapiens
  misc_feature (48)..(48): n is a, c, g, or t
  misc_feature (54)..(55): n is a, c, g, or t
tctagaggatccgcgtgtggttctgtctggggatgtcagggatgcatngtggcnnttgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341297 - DNA, 1205 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccagccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaatga

SEQ ID NO: 341298 - DNA, 721 bp, Homo sapiens
gccacgtgtccggctcggagcccacggctgtcctcccggtccgccgcgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggatacatgacgtagtgagcgatcagagaaagtacactctagat

SEQ ID NO: 341299 - DNA, 444 bp, Homo sapiens
ctgtctgggggagatgatgagtaagtggcttcttggcccctggctggagggcatggccttggggtgccaggcggggactctcctggctcgcatcctgatgggtggattggatgagctggggattcccctgagccaggagcgtcgcacaagtgaaaggcggcttttgctggtagctgctgtgcttgtgggtctgtgtgtctgagagtgtgggggtctgaacgtgagcgtggtctcctgtatatggagatgtctgctcttgtgaacttggaaagtcagtctggggttgtggactaggaaccagaatatgagcatccaatccctgctatttcatagccatttctcggtttcatcacctgttaaatgggaaaaggacacattcctgctctgcctactcatttatgcagcatatttgtgttaagtgccttctgggtgcagaccctgtga

SEQ ID NO: 341300 - DNA, 253 bp, Homo sapiens
cagcatagatttaatttgtttgtatataactaaattactacttgaacatgtatagctccttctatagctccctgctcaatgtgcagtttactcataatttttagattggtctccagctgctcctgcctcagggtggcattgaggctacacattaaattttccacctacttccaatcttctaagctttatctatgctgtaagtttttaaacttttttacattaattattactctgagaaattaattaaagagat

SEQ ID NO: 341301 - DNA, 503 bp, Homo sapiens
tctttattccatccacaactttaattctcctttgccaggtaacacaacataggctgtggttttggggattaggatgtggacatatttgagggtcattattctattacagtagcactggggtggtggagcccaggaaattacccttttaacagtcattccagctgattctaatgaaaacaatcatgacaacacaatttgagaaacactcctttggttatttacgcataacagctatatttattcaactttggaattcaaacaaacacagaggtggtttaagactttttaaacagaagatttagtacaaagagaaaagtaaaatcagactctgataaacacggttatctacaaagacctgtttacacagaaagaagagacactggccgatttcttgatctttccctgttttattctgaaaacagcctgaaaaccaaatattaggaataacacctataatataacttaagttatgacattaaattttacttggttttaaaagtata

SEQ ID NO: 341302 - DNA, 422 bp, Homo sapiens
tctttattccatccacaactttaattctcctttgccaggtaacacaacataggctgtggttttggggattaggatgtggacatatttgagggtcattattctattacagtagcactggggtggtggagcccaggaaattacccttttaacagtcattccagctgattctaatgaaaacaatcatgacaacacaatttgagaaacactcctttggttatttacgcataacagctatatttattcaactttggaattcaaacaaacacagaggtggtttaagactttttaaacagaagatttagtacaaagagaaaagtaaaatcagactctgataaacacggttatctacaaagacctgtttacacagaaagaagagacactggccccgcacatccgtactgcccgggatcctctgagtcaac

SEQ ID NO: 341303 - DNA, 402 bp, Homo sapiens
cacagtgaggatgtgggtaaaacatgtcacctggcatggtgcctggcatggtccctgctcaagaaacgcgagctgctgtcaagattaggggaggcggagtagcctagtgtttaagaacccaggcttggccgggcacagtggctcaggcctgtaattctagcactttgggaggccagggagggtggatcacttgaggccaggagttcgagactagcctggccaacatggcgaaaccctatctctattaaaaaggcaaaaattagctgagcatggtggcgggcgcctgtagtcccagctacctggggggctgagacaggagaaatgcttgaacccgggaggtggaggttgcagtgagccgagatcgctctgctgcactccagcctgggggacagagcaagactc

SEQ ID NO: 341304 - DNA, 333 bp, Homo sapiens
tctgcgtacgtgcccatgactgacatcaatgtgtgtccatgtgaggtcatgtgtatggtgtgatatccatgtgtggtgcccatgtgtgccatgtgatacccgtgtgtgtgtgctgtgacatctgtatgtccccgtgcggcccatgtgtgtgctgcgatgtccatgtgtgatgtctgtgtggggtccacgtgtgtgctgtgatgtccgtgtgatgtctatgcaggcctgtgtgagacccatgtgtgctgtgtgaggctgtgtgtactgtgacatctgtgtgttatctgtgcgtgcccatgaggcctgtgtgtgctgtgatgtccgtgtgtgatg

SEQ ID NO: 341305 - DNA, 1122 bp, Homo sapiens
acagggctggaggagcaattggaggagcccagcaggctggacacatgtggagagttgatatggaaactgagccctcacacatggactgaattctgacaagcagaggataaaggcagaacaacatgactgaaggcgatgaggaacagctgatcacctgtggaagtcatttgtcctaaattgtcatggacagaccatgtgccttacagcaagaaaattctgtgaataaacaggaagccagccagccagggaagatgcttttgtgatatatcccagcatgctgatgaccccaaggaggaccactggatacctagcaaggagctggctgcagcataccatgaatcctcacagcaacttaatgaggaaaaagaagaactgattgaagagtggcaaccagaacctcttgttcctcctgtcccaaaagaccatcctgctctcaactacaacatcgtttcagggcaatatgataaaattgaaaaatttcacaaatgtcaggagaacaagatctggtgtctgggtttcaactcttagagcttcccagctcgtagctatgctcctgaattcctctggcagccctcctcaaggacctctgtgagacaaagtcagaaatgacttcactggagaccaagagagcccacagagctcttcctgctgcttcttctacccttgtactcactcggctctctaaatttgtctcagctccagatccttttatcaatattttaatggattcactatgaaagaaggcctttgcattgctgctgactccatcagaatctcagaagtcttcctggatcagaaggggacccaattagaacctggaaggcccgctactcataggcaggaggccagaagacttgccctagtgccgaaatgttgttctgttaatgtgtatctcatgcccagtatttcttattaataaggcactaaataagggacaatccagcgtttccattgccaaaagaacacatctcccttttaattaatcaatgtaaatggccttttactggaaaatagaagtaaagtattcctagaacataggatataatgttacattggggaatatcatgccctctttttattttaaagtggagatttttttttttaatgtagagacactaggtc

SEQ ID NO: 341306 - DNA, 944 bp, Homo sapiens
acagggctggaggagcaattggaggagcccagcaggctggacacatgtggagagttgatatggaaactgagccctcacacatggactgaattctgacaagcagaggataaaggcagaacaacatgactgaaggcgatgaggaacagctgatcacctgtggaagtcatttgtcctaaattgtcatggacagaccatgtgccttacagcaagaaaattctgtgaataaacaggaagccagccagccagggaagatgcttttgtgatatatcccagcatgctgatgaccccaaggaggaccactggatacctagcaaggagctggctgcagcataccatgaatcctcacagcaacttaatgaggaaaaagaagaactgattgaagagtggcaaccagaacctcttgttcctcctgtcccaaaagaccatcctgctctcaactacaacatcgtttcaggaaacatctgcgtgagaagggcccctctcataaaatgaaaacaaaggacagaaagcattgctgagggcttaaggtgtggatgaaatgacacattgaagctgaagaatccccatgttgacagcattcaatccaagaaaagctccactgtacacatgttctaacatatgagtgatccaaaagagagagcttcacatacaatatcctatgcctactttctcagctcagagagagaggctcagtcattcataaactggagcaacattcatgtactgcggaccactttgaaagacttatctgtctcctgtttacagatgtgtacagcaagctgcaaagcactgcctgtccttttactcacaatcaattgcagagaacatgaagtacagaagacaacagctttttttttcttttggaaaatcccttaagtcctttccgtgctgtgctatcattgttcaggtgctaaagtgaaataaatgtgtcgtctaatcactaa

SEQ ID NO: 341307 - DNA, 604 bp, Homo sapiens
gagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagat

SEQ ID NO: 341308 - DNA, 297 bp, Homo sapiens
tggacagttccctcctgaaatgcagggatggaggaaacaatcagaatgccttctgctgccatcttcaatgaagcactgactatgtgcctgctgtatgccgggcatgcttccctttgtgtatcctgaattcagcagtattcagcacatatttattgagtgcctgctaccatgtaccacatattcctctagactctgggcacatagcagtgaacaagacagataagacttctgccttgtggaacttaaaatgcattaggaaaaagcacaataatcagataagcatatatatattggata

SEQ ID NO: 341309 - DNA, 146 bp, Homo sapiens
ggaataacggattctgctcttaagggtagtgccagagctaggaggaatgtggagtcagtgccaagcgaggagccttataatcttatgtctttctcttatcttttcctccctctctcctctgcctccatcctccccctgtcctttgt

SEQ ID NO: 341310 - DNA, 390 bp, Homo sapiens
ctcccttgcagaaagtcagctcacaggaagcaggaccaaaatgttttgctcgccgctgtggctttatcaacaaaaatactatctgacactgacttattcgttgcataagtaaaggaaataaacagctggctttcccctatggaaatgaggaactgctgaagattctgaggaggctgggtaacagaactcaggccctaggagatgaatggttggttaagtaagcaacgatatgattgcacacagaggggatggggcactgagagcagttttggaagactcctgccacagtccagcgtgagggagaccaacatgcactggggggtggtagtgacatgtttgacatccttccttctcctctactcggtatacacgtaaggctctgtgttaggc

SEQ ID NO: 341311 - DNA, 1061 bp, Homo sapiens
gcccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcct

SEQ ID NO: 341312 - DNA, 1017 bp, Homo sapiens
ttcgtaattgtccagaatctacagtaattctgatgcaggttgactcagtgtccatattttaagaaccactagtttaatgatgattccactggttggaatcatctctttggctggtcccaggataccctgaaggcagtaggttgtgcagaatcagatggaacacacttatggaggcatgagagtcaccaagtgaaccttttgtgcaaaagtgcaaatttgatttggaattctcaaagtcctatttattacaaaaacaaaggaacccagtcaaatgaaatgtgctggatagaaaattgtggtctttccatagaaaaacctgtttcaccagtgctttgttattcgaatatttaaggtattcatatttcaagtttattaaaccagtttaaatgctcctccacctacttatgattaaaactttcaactctttattaccttggttaatgttgactaaggacctccatgttgagggaaagtgctggggttaagcaaattgaacctttgtaggcccagacaggaccttaatcaagatataagaggccaggtgtggtggctcacacccataatcccagttttgggtggccgaggtggaagaatcgctgcagcccagggatgctgaggctgcaatgagccttgatcatgccactgcactccagcctgagcaacaaagccagaccctgtcttaaaagaaaaaacaaagaccctgaactgcagtcacactttcctaaatacctagtaaaattagctggttaaatctagtaagacgttccccaaagatttacggcagatgctgttttatatatattgctgtgtccctctgtgacaggaagttacagggttctttttaccagtagtcctgtacccggggccttgcaaatcagtgtcatatggtagagaacagaatctgatcacatttcctacttcctaagcaagtaccagaatatacttactaagcttgtatactgccctcaactgctatatatttttttcttttttttttttttttggtgatagtagggt

SEQ ID NO: 341313 - DNA, 585 bp, Homo sapiens
aaatcacacacccaaaaagcttaggtgataactgcaaaggatttttttgggggcggttgaaggagaaaaagggaaggagtatttttgcaatttaaacatcctctgtaatttttcccgtaaaatcattcgtaaaataaacattactcattagtgccttatgaagttctccttttggggaatgtgattaaacatatggcctttattttatttttttgagatggagtctcgctcttgcccagaccctgtcttaaaagaaaaaacaaagaccctgaactgcagtcacactttcctaaatacctagtaaaattagctggttaaatctagtaagacgttccccaaagatttacggcagatgctgttttatatatattgctgtgtccctctgtgacaggaagttacagggttctttttaccagtagtcctgtacccggggccttgcaaatcagtgtcatatggtagagaacagaatctgatcacatttcctacttcctaagcaagtaccagaatatacttactaagcttgtatactgccctcaactgctatatatttttttcttttttttttttttttggtgatagtagggt

SEQ ID NO: 341314 - DNA, 492 bp, Homo sapiens
ctctaagagactctgcgaagagacacattgctttggaggaatcagccccaggccaaagcaacaagcaacaccagagtcctgcggagagctgagaagcaactcgcccactcagacatagacacacagatggacaaactgggatgcagtcctggatctaaacaactctgcaacctgcttcctggggacattcacgcccttgccacagttgcaggaagctggatcgggcgtttggggctggtgagggaaatacagcagcctggaaatgtcaatcagtgtttttctcagactttaaggcactgggaagtggggccagggaggcgtccactgtttctctagttgcctcagccacagcacctacattaaggaggctgcaaaactggtttcaatctgacgtggaaaagatgtctttcagcaattggtgattatatgaattgccactcccttcgatggaagctgccttggaaataaaggcagttgccctagtgagttcag

SEQ ID NO: 341315 - DNA, 312 bp, Homo sapiens
acagaatacaccccgtttttcacctccttcttttaagatgaagttacatactgttcaactataccagaccatttaccactgttgtcagagacacagaaaattagaagttatccccaaaaaactggatcaagtcccctactctcagggatccccaattccaacaaaacctttcagtggctcctcaatgcttaaagaagatgtctctcctcaagtccaaataacatctccttgaaattcccactactccctaacctttctaccattcccaaaggtcactcttagccctactgccacacacacccctccccctcc

SEQ ID NO: 341316 - DNA, 443 bp, Homo sapiens
gcttttcctgttttaagtgtcttttatgtttattttatagtttgtttgtccaaattgggatcttaacattccacttggttggtttgcagtttttggttcaacttttcctttcctacttctttttttaacttaaaatttgagaataagttttttttttccacatttcgaacttttctaattgcagccctgtgataacatttaaaatgtcatctgatagtttttaatgtttttactgtaaacctgggtttgctgtaaaccattagtgatatctagagatttgattagattttaggttttttttttaggtttttctttttggccaaaaacttcataagtggcttgtacttctttctgcatcctctcaggaggcacacaaggctggttgtctttttctttttctttctttccttttttttttttttgtctggctctgctgcctaggc

SEQ ID NO: 341317 - DNA, 152 bp, Homo sapiens
ctgtaccaatgaagttgtcatctttccattccttcaagtaactagggctttatgtcagctgggatggatctttcggaagtccctctattagcactttgccattgtgagtacagagacaccccagaagttcctgcttctgtattcttcccatt

SEQ ID NO: 341318 - DNA, 1021 bp, Homo sapiens
agcggccttttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatagggtcttgctatgttgcccaggctggtctcgaacacc

SEQ ID NO: 341319 - DNA, 1269 bp, Homo sapiens
agcggccttttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaaggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcaaaaaaaat

SEQ ID NO: 341320 - DNA, 465 bp, Homo sapiens
gcacgtggggccgcgcggccgggttctgaggaccatgaaagattgatggggggcggagccagccgcagtcaccccctccgggctcagccctgggtttagggttacagccccacctggggcacctgccccttgaagggggctgctggggtgtccccatcggcaaccctctgagcccctcctctgaaacgcccaggatttcaaggtcacaggctgccctctgctgggggcaccaccaattaatactggggctcctgatgggataagggtgtcctccatacaccggccgttttctggagcccttgccatcttctgcctgggcttgggcacatgaggatggagagagcccccctcacggctctgctacacccggtatccccagatggcatccgccacagactcgcgctatgggcagaaggagtcctcggatcagaacttcgactacatgttcaagattctcatcatcgg

SEQ ID NO: 341321 - DNA, 525 bp, Homo sapiens
ttcctcttccgctatgctgacgactcgttcacgcctgccttcgtcagcaccgtgggcatcgacttcaaggtcaagaccatctatcgcaacgacaagaggatcaagctgcagatctgggtgggtcccagctggagggctcccgcccggctcggttggattcccgtacttggaaaagcagccccaacctcgtctatctctttcctgactggagtcattcacttacacactgggcatttatcagtaaggtgcccactgtgtaccggggcagaaacagcacctgtgttctcccataagcacctaatcctggtccctcagtttccccatcttcaagttcttccatgtatgaggtttcagctggatcttggtccccattctctttttttgtttgttttttgagacagggtggtcttgctctgtcccctaggctggaatgcagttacgtgatcacggctctctgcagcctcgacttcccaggctcaaaccattcttccacctgagcctcctgagtagctaggaccacgggct

SEQ ID NO: 341322 - DNA, 1497 bp, Homo sapiens
agcggccttttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcaaaaaaaat

SEQ ID NO: 341323 - DNA, 1378 bp, Homo sapiens
gaattccgcgtagtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcaaaaaaaat

SEQ ID NO: 341324 - DNA, 832 bp, Homo sapiens
agcggccttttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactgatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcaaaaaaaat

SEQ ID NO: 341325 - DNA, 275 bp, Homo sapiens
gaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacaggtgggaat

SEQ ID NO: 341326 - DNA, 715 bp, Homo sapiens
gggaattccatgcacattctcctagtgacaaaatgacagcccctgccagtctcttccgtctccattcctgcgtcgaggcctgaaatccagtcttccgtacctaccggagaccaaatgtgccaggcttgtcttacaatacttaacatttcctctgcctttctgtcttaaccttctaatcaactacattaaaaacctaggcccggccttcatctctttctttgccctccccaccccattcatcccatacctggttaacaatgatttgtccttcctgtgtgcccataggactcattcctttagtctagcacataccacactcattacttgttcagtgtctttccagctcccacccacagttccatgagaaagggaacagtgttttaatttttgtttccctccttcttactatagttcactatatatgtagtggagcctcaataaatattggttgaatgaatgttaattcgtaagtaaatataaaatgtattctgttactcataattatctgaataatcttaatgtatggactgtttgtaaaattgaacacattggaaaaatgttcatttattctgtaaacatttgcaaatgtctactatgatctggagctataaaaattttaagacaaaattcctgtcttcaaaattttcacagtgggatcagggaacagggaagcccgtatttatcagagtgcttttagtttatcatttgctattaa

SEQ ID NO: 341327 - DNA, 262 bp, Homo sapiens
gcagagcttgcggtgagccgagatgatgccactgcactgcagcctgggagacagcgagactcccgtctcaaaaaacaaaacaaaacaaacacaagacgattatctcagatgtctttacttatcctaaaagccaatgacttctgtacgattgcagcacaccccctgcccaacccaattctatatcctgtaaagaatataaccttgcatctatcaattataaaaatgtccttcatcatctataacccatctatatccttctccc

SEQ ID NO: 341328 - DNA, 658 bp, Homo sapiens
aaagagatgactaggctgagactgcctggaaagaaaaccccttagggaattggaggagaagacttccaagtctacatgcataagtacctccaactttgaccaaccagtgctaaaaacaggagtgggcgttggagctggtggatgggagtggggaaaggagagaggtcagtgccctggtcatctttatttgctagtccatgatgcagagaacgagagctccccctccaagcctacgtccagggcatatggcaaacaagaaaaggggcttcagtggaaggatctcattgtaaagaaacaattacaggaaggggtagtgtctgtggtaactaacttcaggctgcccctcaaaacacctaaaaagccctcttgccacggagaatcttcctgctgcctaattatttcccttccttaactgcccctcataccactgccccacaggtcagacagaactcttatccagccaagtaatgtatgaatatatctaaattctttcctttccctgtgagttggaaatatttaaaataaggacttacatggtaactagcagaatgacccattaaaccagaccatcacacaccacttcttatgaggttgcatgcggaaaggttactggacagatttttaaaaatgctttcattcttattgtaaagaacaaatc

SEQ ID NO: 341329 - DNA, 183 bp, Homo sapiens
agagcacgatcctgtctcaaaataaaaataaagaataaaaccagtgtttccacatctggaactttcttttcaagtttatatcacctctccttccaaatcaggtctcccctcttccaggaagtactccttgattaagccaaaaatgttttaattttcaccacttgtcctattactctgcatccc

SEQ ID NO: 341330 - DNA, 211 bp, Homo sapiens
aggatatttggatagctttgaggatttcgttggaaacgggattgtcttcatataaactctagacagaagcattcccagaagcttcattgggatgtttcaattgaagtcacagtgttgaacagtccctttcatagagcatgtttgaaacaatctttttgtagtatctggaagtggtcatttggagcgttctcaggactacggtgaaaaagga

SEQ ID NO: 341331 - DNA, 674 bp, Homo sapiens
tgagacagagtcttgctctgtcacccgggctggagtacagtggcacaatctcggctccctgcaacctccacctcctaggttcaagtgattctcatgctccagcctccctagtagctgggactacaggcgcacgccaccacgctcagctaatttttgtatttttagcagagagggggtttcaccatgttggccaggctggtctcgaactcctgacctcaagtgagccaccatccttggcttcccaaagtgctgggattacaggcgtgagtcaccatgcctggccttcaaattgtaattagcatgcatcactttatgttatggtctgaatatttgtgatccccaaaatttgtatgttgaaattctgacctccaaagtgataatactaggaggtagagcctttggaaggtgattaggtcagaaggctagagctctcatgaatgggattagtgcccttatggaagaggccccagggagctcccttacccaatgggaagactcagtctgcaaccccttagagagccctcaccagaacctgcccgtattggcaccctgatggtggactttcagcctccagaactgaaggaaatacatttctgttgtttttcagcccccagtctatggtgctttactataacagcccaaaaagactaaactacttgataatttaaaaaatt

SEQ ID NO: 341332 - DNA, 700 bp, Homo sapiens
caagcttggcccagcctcatccacagaaggatctggcagtgatatcttggcattcatagtctcagtgtgcaggacagcattggttccccaccctacagtcccagctctacctaggcagtatcatatgtatcatggtaatggctatggaaaataatatccctccctccctgcctcccttcccctcttcctctttttagagatgaggtcttgctgtgttgcccaggctggtctcaaactcctggcctcaagtgatcctcctatctcagcctcccaaagtgctgggattacaggtgtgagccaccgcatgcagcctctttcttttttgacagggtcttgctctgccatccaggctgaagtgcagtggtgtgatcttgtctcactgtagcctcaacctcctaggctcaagagagcctcccatctcagcctcttgagtatctgggactacaggcatgaactgccatgcctagctaattaaaaaaaaaaatatatatatatattatatatatatacacatacatatatatatatatgtatgtaaaatatatatatattttacagggtctcactttgttgctcaggctagtctagaactcctggtctccagcgattctcctgccttggtggcccaaaatgctgggattataggtgacagctactgtgcccaaccttgtttctttcagtgaccaaatagctttaaata

SEQ ID NO: 341333 - DNA, 355 bp, Homo sapiens
tcttgggttcaagtgatcctcctgcctcagcctcccaaagtgctgggattataggtgtgagcttctccactgactatgatttaattctaatgacagaatttaacccagttttatctttttctttcttagccattaaattttggttcaagcttcagaaattggaattccctattacctaaaagtatatgattttgataatgtgctgaaagttgccattgtttctctttactttttaaaatttcagtctttgttcccttgttttccatacacagcaaattcaatcttattttttttttaatgagccaataaatctagtttgttctgatgctagatttgaaagttaagatgaagatgg

SEQ ID NO: 341334 - DNA, 474 bp, Homo sapiens
gggatggtcgttactggaatgttagtactcctgattgaagttaccacaacttacgacgttgggaatatctttgaataattttttttttaaactaatactgtgccttaaaacccccagtgcgcgtcgtccacctgctctgctctttgccacctgtttgctgagcacctcggtgctttacgtgagcgtggtgtctgtcctgtgtttacaaagacatgagccttagggagtctttgatatgttaatgctcactgaatttctaaacccaaaacatttattttatcttttttccaagagagtctcactctgttgcccaggctggagttcagtggcacgatctcggctcactgcaacctctgcctcccaggttcaagcagttctcctgcctcaagcctcctgagtagctgggactacaggcacacgccaccacgcctggctaatttttgttttttgttttgttttgtttttttgagacag

SEQ ID NO: 341335 - DNA, 266 bp, Homo sapiens
tcaatattctatgaaatgacagattctgataagtgtttctcagtttcagtgggtgtaaatcttttgtttgtgggggttggtttcctttaggagaagttaattgaactgatcctcaaaggatgaaatttaaacacctcaaagtcagcatttctccgtgttgtccagtgcctagtgaagatgaagacttttcttgccattgcttgactccaagtaaagctgtgaatgtagttgagcgattctccagacctgccagctgcagtttccct

SEQ ID NO: 341336 - DNA, 175 bp, Homo sapiens
tggccttgagtcctaccacgctcacctcccagacaaatatacttagcaggtgttttccccacattaataatcagaattgacacattctaaatgaggccctccttgttgtgcagggcagctctgatggatatgtggggaattgacggctcttgagaaatgtttttgccactaccag

SEQ ID NO: 341337 - DNA, 109 bp, Homo sapiens
tggctaaaagagaacactcattctaggttgtctcttgaaaacaaacagcaatcgtcttggactccctcaattcttcttttattgtgaagtatagtgcagatactgaata

SEQ ID NO: 341338 - DNA, 154 bp, Homo sapiens
gtgaacgaatgaagggctagaatggacgccagtccagtttctcagcctcagcagtgttgatatttgttgccgtcctgggcacggcactgcagggtgttaagcatcatccctggcctccgccttttgcaggccagtagcagcccctctcaccatg

SEQ ID NO: 341339 - DNA, 318 bp, Homo sapiens
tcatcaaagtaaaacttttgataaccaaagagaattaggaaagtcctaacagcaagcagaggatgtgaaaaacaaaaagaattgtcttcaaaggagtagtgattagaatgactacttcctttttaacagaaatattacaagtataaagataaaagaaatttaaagtgctgaaagaaaataactgtcaatttagtatatctatatccataaaaaatgtcctccatgaatgtgaaacagatatcttttcagaaattaagagcattctccactggcaaacacatactaacattcagaaagaacaaaagaacatcagtgtac

SEQ ID NO: 341340 - DNA, 707 bp, Homo sapiens
taggcctgagcatcttctaagaacaaatgcaataatagccagtggaatggaatagcttccatattcctttaggtgggactttaaattctctcaataacaattcatattaaacgtcattccctttgtcaagagactgagttctttagttctgaccaccaaaccttactgttcacaagtgttagaattatgtcgtcctagagctggaagaacccactctgaagactacccactcattttgtaaagggtattagaacccaagaaaggggatggacttgaccagtgagtctgaaccaggactggagctaggatattctaccttctagctcagtgcttttgcatctttttgatgactattttgtgatttagttctatgatgaagcattcaaaataaatcccttaactgtccatgccactgtttattcatctgtaaaatgaagattgtaatttccccattgattttttttttttttaagttcctcaagagctgggactgtgccatccatctcagtatttcccaaggcacctaactcataaagtgctctacacacagagctgctcaataaatgttcactattgaatagttgaatgaatgaatgaatatgacttttaattgggctttgcaagtgatgactccttcagaattaaatgatttttcttctaagttgtgtgcacattctcagccattcatttgttaaatatctttcagg

SEQ ID NO: 341341 - DNA, 232 bp, Homo sapiens
atacagatgatggaatagtacccagccttaaaaagagaggaagttccgacgcagggagtgacacggaggggccctgaggaccttgtgctgagtgaaataagccagtcacaaaaggacgcatactgcataatgccacttataggagtccctagagtcatccaaatagagacggaatgtagaatggtgggtaccgggggctggggggaggggaaaagatgagttagtgtttgac

SEQ ID NO: 341342 - DNA, 281 bp, Homo sapiens
cctaacacttacaacccctcgcatacagtgtgttcaacacatgcttgtggaacaatgaatatggaataaaggaatgtccgtaatcacttttaaaaatatacatatatagtgcttgagaaagaaatacactggtgcttcccaaatatctgaaactatttactaagacatgcattagtatgtcttagagttaagagattactaaaactgattttactttagcaaatacccaagaagaaaacctaacctagaaaatggcacaagactgcaaacaaaaattggaa

SEQ ID NO: 341343 - DNA, 731 bp, Homo sapiens
gctctcggcgcgggcccctctgtctgtggtgatcttgtgatgaaccaggccaggtcagcgctccctcggcctcgggagctgaggagagcagttctgtccttagggacacgagccccctgacgctgcagcctctaccttgtggacgggacccctaccccaccccggctgcccacctggcaccgttgactgcagaacacctgcgtcccgtcccccgccccgcccctcgcccttgtccctgagccccatcccaccctctgtggaagagcctcatgctccaggcggggccggtgctgggcaccagccactcaggctctcccagggtgtgcatgtccccatctgccctctgctgtgcacacactgtctgggttgttcttagcgtggaatccgcgtgtgtggtggctacaggaatgtggaagccctgggcagcgtgtggctcacggtgttggtgccactcggcgcagactagggggcggccgcttcctctgctctacgaggctctggtgcccgtgacttacatctccttcttgtttctttctttcctccctccttcccttccttccttccttctgaaaaatgcactgtcttaggtgcacacaggaaaacattgtacacattcaccccatgaacccaccagcacgttgacagagcaggctcctgcacacagacagctccctcgggcccgtatttaccctatagcacccctatctaccccctctagagcagaagtcgac

SEQ ID NO: 341344 - DNA, 958 bp, Homo sapiens
gctctcggcgcgggcccctctgtctgtggtgatcttgtgatgaaccaggccaggtcagcgctccctcggcctcgggagctgaggagagcagttctgtccttagggacacgagccccctgacgctgcagcctctaccttgtggacgggacccctaccccaccccggctgcccacctggcaccgttgactgcagaacacctgcgtcccgtcccccgccccgcccctcgcccttgtccctgagccccatcccaccctctgtggaagagcctcatgctccaggcggggccggtgctgggcaccagccactcaggctctcccagggtgtgcatgtccccatctgccctctgctgtgcacacactgtctgggttgttcttagcgtggaatccgcgtgtgtggtggctacaggaatgtggaagccctgggcagcgtgtggctcacggtgttggtgccactcggcgcagactagggggcggccgcttcctctgctctacgaggctctggtgcccgtgacttacatctccttcccttccttccttccttctgaaaaatgcactgtcttaggtgcacacaggaaaacattgtacacattcaccccatgaacccaccagcacgttgacagagcaggctcctgcacacagacagctccctcgggcccccttctcccgtggcggccccgcgacgaccctgcgaggacccgggtcccgcttcctagagcagagggccttccccagctgtgccgaggtgggatcacgggcacgcagccttctgtgtccgcctcccgtcagtcggggtgatgcctctgggtctcacctgtgttttcatacgacccagcagtttctgataacggttccatcacgtgaacacagcacgatttgcttctccagactcttggtgatgcattttgtaagtttttggctaatattacaaacaaaacttgtgtgaacacatttctgcccgt

SEQ ID NO: 341345 - DNA, 294 bp, Homo sapiens
ctacatgggaggctgatgcaggaggatggcttgagcccaggaggttgaggctgcagtgagccataatcatgccactgcattccatcctgggcaacaaagcgagacccttgtcacaaaaaaacaaagcaaaacaaaaaatatgtatatagtgccaactgcctattagaaataactcccttttagtccttagagtgaagttattcccatttcacagatgagtaaacttggatgtactgaataacttgtccaaggtcacagaagttgtgcaaaattgagatttgaactcagggttgt

SEQ ID NO: 341346 - DNA, 454 bp, Homo sapiens
ctcacaatcaaggtagagatgcttctggagtggtggatggagttacctgtgttctactcccttggcagagcaggcatcagggtattaaaggggcaaagagctgacgtaggagtaggtagagctggaaggcactactgatatcttcccagccccatacagagtgtatttgcatcagacttgtctctaggttggagcggcctttcttgacatggggaaataatgcatctccagctcctggtgatgtcttgtctcgatcctggaaaggttggatcctggccaattgtccctagaagcattttgaggacccacctgtactgaagtccatctccctggggtagttttctaccaaaaccaagtgcccagcactgcctatgtctcttctttccccagcctgtagtcatgaggtgtagtgaagctttcagggaatagccagccacttgcagggcagttacag

SEQ ID NO: 341347 - DNA, 422 bp, Homo sapiens
cgtgtaagcgtggaatccgaccacattttgtacaaaatattagatctataaagtgcagcttttctgatgagatagaataatgaaggcaactgacattagagggctcttactagtttcagaagtatttttcaccccacacgttagatacaagtatacattttctttcctccctagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggttggtcttccccatcccccttctctaacggtgtaatatgcatgtgtcctggagctgttttcctt

SEQ ID NO: 341348 - DNA, 257 bp, Homo sapiens
gttcttcaaacattttcccactgcactccgtccatcattcatttccagaatttcatagttaaatcatggagtagagtctaggaaatgatatcaaagatgcaaacaggaaagcaacctgctgcaggacagtagtaccagtgatagtgacctgacttgtgactcaagcacgagctcatcagatgatgatgaagaggtttcagggagcagcaagacaatcactgcagagataccaggtagaggatgttttttaaactgac

SEQ ID NO: 341349 - DNA, 2999 bp, Homo sapiens
gggcggaagtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttggtctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagaacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgtt

SEQ ID NO: 341350 - DNA, 958 bp, Homo sapiens
cgtgtaagcgtggaatccgaccacattttgtacaaaatattagatctataaagtgcagcttttctgatgagatagaataatgaaggcaactgacattagagggctcttactagtttcagaagtatttttcaccccacacgttagatacaagtatacattttctttcctccctagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcctcctaaaaaagtagtagtatgggccgggcgcagtgtctcacgcctgtaagcccagcactttgggaggccgaggcgggcggatgacgaggtcaggagatcaaaaccattctggctacggtgaaaccccgtctctacta

SEQ ID NO: 341351 - DNA, 1447 bp, Homo sapiens
  misc_feature (1243)..(1243): n is a, c, g, or t
  misc_feature (1313)..(1313): n is a, c, g, or t
  misc_feature (1343)..(1343): n is a, c, g, or t
  misc_feature (1422)..(1422): n is a, c, g, or t
  misc_feature (1437)..(1437): n is a, c, g, or t
gggcggaagtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtcatttggatccaggattcctagcaagtgacaaaacatctgctggcaatgcgccactcaatgaagaaattaacattgcgtcttcagatagtgaagtagagattgtgggagttcaggaacatgcaagatgtgattgaagagcatggtccttcanaaaaggcaataaacggcccaactagtgcttctggcgatgacattttaagctacagcgtctccaggagaanaaaagattaataccttgaagaaacactcanaagcagcagtcctgaatggtgttcatctgaagaagttcctagttacaggtctttacattacattaccatagtgcttgtncaacttgccaagatngtatggtcgc

SEQ ID NO: 341352 - DNA, 284 bp, Homo sapiens
gtgctgggattacaggcgtgagccaccgcacctggccgattgtcccttcttatgtagtgataaagtaacctttcttgaactgtatcaatccatcaccagtcaagttgctgcaacttatccactggtcttgaatggaaaatgtgttgattctggtaaagcttctctgtctttccctgtgtgtgaaaccttaacatctctacttgggaacacagacccccttcatttggagttgatgtttccaggtggctatcctcaagttttgtgttcacataaactctatactt

SEQ ID NO: 341353 - DNA, 183 bp, Homo sapiens
tcaacagccagctcgctttaattgaacaagtcatttgacttcagggttcactgggtttaggtaggacactccaccaggaagcccacaaagcatgaatgtcacagtccgaaccaaactgcagagcaccacagacgtccagagctagaaaacatcatttgaccaggagagccggtccgcatgtct

SEQ ID NO: 341354 - DNA, 253 bp, Homo sapiens
ggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaa

SEQ ID NO: 341355 - DNA, 530 bp, Homo sapiens
tgcctctccctagccatcaagtgttgccactctacagagctcctcttggccttctcatgcttacctgttccttcttctgtgccctacccatggctcttaccacagtgcactatgactgtctgcctcctgcactaaaatgttagctccttgagagtcaggactgaatcctgctggtacccatagcatccagcacagtgtccaatacatgcagctgttgaatgaaagaatgcatttttaagaacagcatcagtggacttgactgtgttttgaaagctcctattggccctggatcagatgtcacagggtaaggggaaagatttatttatcttttaaaataaacagctttcagagaaccactgacaaaaccatttccacctttggtggaagcagagagttggttgcatgtgtggcagtcatatactttttttgtcttccaaagagcctagggtttttttttgttttgttttgttttgttttttgccaaaagatgagagaaggcaaatatcttggtgcagaaaaggccttgggga

SEQ ID NO: 341356 - DNA, 160 bp, Homo sapiens
gttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttatt

SEQ ID NO: 341357 - DNA, 261 bp, Homo sapiens
aaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagg

SEQ ID NO: 341358 - DNA, 148 bp, Homo sapiens
tgtggttaaggtctggcttttcctggggagggacctagctcagtccagaacagcatttgtggaactcattttcactatcaactctctgggaagaaaaccctgctgtttgggtttcctgccagcctggtgggaggcttcctggacagca

SEQ ID NO: 341359 - DNA, 484 bp, Homo sapiens
cctgggcaacaagagcgaaactccatctcaaaaaaaaaaaaaaatacaaatcttaaaacaaaaaagctttattttgatttccttattctttattttattgttcaggtaagtagtctgtagtaagagcagtttagagattctgcagtgtgtttccaacaaccaccaattctctgattctaccacatgaactggtgtcctgctattcaatgctattctgacactgactaccctgaattagtatcagactccacaagtttaaggactcattcctacaaaattgccctcacttgagatgccatttgcaagtcctgggtccccaggcttacccacatttctgccttctgtccaagctggctatagattttggggatgccaacaatgccactccatgtgatcatttgctagggtgagtcatagaacttaggaaaatgctatacttgggattacagtttcattataaagtatacaattcaggaacagccaa

SEQ ID NO: 341360 - DNA, 520 bp, Homo sapiens
agcagcatgaaataatgtaggatgaatctagagaagtttgaaagagatcaaagcaggaacgcaggataaatttatctgaaagaatattatccctgctgctgtctgtagaacaaactgaagggaaacaagtagagaagagctgagtattcaggcaagaggttactccagtggtaaaggtaatgtaaccaaatgcaggtccgaatcgttgcagtttgcagagtccaattaacaacgacaaggtctggtagaaagacagacactttattaaccaaaagtaaagggaaggggtcagattcctatccaaaataaccacttcaatttttgaggggaaggcagggatttaaaaagggaaaacttgataaggaagacatacaataattgagctgagtacaatgtgtgcctcaaggttatatcttgataaccaaggaggaaaaaaaagttttaaaatgaattttgaagttaagctgcctggttacagtaatggcttgaactagagataactcaattcctgcctaagctg

SEQ ID NO: 341361 - DNA, 122 bp, Homo sapiens
caagtacagcataacaggtgtgaaagcagggtagcatagaaatgatgtaaaatgaaataaattgttcataagaagtgctgaaactaagctgggcacaggggctcatgccagtaattccagtg

SEQ ID NO: 341362 - DNA, 695 bp, Homo sapiens
aagctgctctggatggctgggtgggtaagtgagtgagtgagtgagtgagtgagtgagtgagtgagtgagtgagaggggcaagtgagtacactgcacagaacacacactgaacaggacattactgacattactatacacagtactgtggacacaaatacacactacattagcctaaagcctgcacagctgccctgggtcaggatcatcaatgtcactgtcttgcgcctgcatatcctgtctccaatgacacatggagctgtcatctcctaaaagatctccttcttcgggaccacttcctgaaggacctggacctgcctgaggctgttttactttttctgtaaggagagatactctctcaaataacaacaggctgggggcggtggctcacgcctgtaatcccagcgctttgggaggccaagatgggcagatcacaaggtcaagtaatggagaccatcctggccaacatggtgaaaccccgtctctacaaaaaaatacaaaaattagcttggcgtggtggtgcgcatctgtagtcccagctactctggaggctgaggcaggagaatcacttgaacccaggagatggaggttacagtgcgccaaaattgcgccactgcactccagcctggcgacagagctagactccatctcaaaaaaaaaaaaaaaaattaacaatatagtgcagtaaatatataaag

SEQ ID NO: 341363 - DNA, 221 bp, Homo sapiens
tggttggagagagtgttttgtggggaaggagcacaggaatcacgtagccagcccagtgtctgcacctcaagttcttctacaaaattggtagagagctctcaggattcgactgtatttagaaatgaggatttacctgaatatactggtctcgtctgtctgataatcagttgcccagattttcagtttgatggggtaagggattatgttgaggggaaagctca

SEQ ID NO: 341364 - DNA, 444 bp, Homo sapiens
cttaccaataattcaccctcaaactcctcggtattcaccagcttttagtaaatttaggatgtgtttttctttcagtttaactctgaaaactggggtttgttccagtgtgactgttgccttctaatcctagtatacagctaacatcttgagattgccttcattatccttgtggtgctgcttttgcttctgttgtttacttttttggtttactctgattcttgtatagcatctttcccagtaaaggtgcatgggagattaaatttttgagttttgcatgtctgaaaatgtctgtatcctcacattcacttgttagactgggcatagaattctagtttggaaaacatatttcttcaaaatgtaaaaattccttttcttctaccttattgtactgcttttgagaaatctaaaactgttttgattattggtcctttaaatgtgatctgg

SEQ ID NO: 341365 - DNA, 1170 bp, Homo sapiens
taaccatttattatacatataatctattgaatataaaaagattcaccttgaaataatatttgactatataggtacatatctgtaaaagatgaccaccttaactaaatcagattttacatttataaattttatatttaattagtcaaatcaatttttaaatcataactccttaatctcataagaagcaataaatgcataaagcattatattaaaataccagggttacttatgtcattgacagggaaaagactttgtataaacaattatgcaccatctatttttgtactcttactcatgatccatttaaaagtctactcagctctagattagataccagaagaccctctaagtaactgataactgagattcgggaccatgtcttgtttgccattgtgcccttggaatttaatacaagtgcctaacccacagtagggttgattgattcactgattagttttactgccatgtgcctataactataggttattctctttccttttctatgttgtgtttattctatttattctctacaatatataaaatgtatttgttctctacaataaatgtgtttattctctacaatatataaaaacatattggactactattacataattaaattactcttttatttgcttaaagagggtgattattttttcacttaccgttccactgagcagcaaccgggactggtcaatagatggaaatcaatcccaatttagagacaatacctggccctgctttgacaatcctgtttcacgtttgccagagtcatgcacttccttacttttgtatataggctccagagaagtttccattaagtgaaacagctatattaattttttaaatatatctttatttaaataattggatgtctggactttatcccaacgtttatttatcaatttttatagttgtcttccaatatatcttttatcatttattttgtaacacattctttggaggtctgtgatttatagtactatgataattcccttattgactcattattcaaagttagatgcagtcttctaatcttagctatttggcataagaagcaatagccaaggggatgtatcctgtactttatgtttaatttgttcttcagtaactacatatcatttatatcagattatcttaagtattaacaggattcacctggatcaaatt

SEQ ID NO: 341366 - DNA, 713 bp, Homo sapiens
aaatggatttgtgctcatttgtctgatagaaagcagtagattaaaaatcatgttgtagtgtccaggcataagggacttggagcagcctctcattatccgagatttccatggaagagcatatgttttctgggcctttaaaggatccaccaactggcctggcaggtaaaaatgtgttttaaggttaagtcagagacaggacatgtggacacatgggcatatggacagttcattgaattctcacataggggtataatcagacaagagagtgtacatatcagtggacgctattttaaattggtagtattgaccagggaccaaatggacaccacttgccatctcaaggctgtaggcccataaatctacgtaaatccttgcaactagtggtcacttcagggtgaaagaggaagagcagaaaaccgttaattgattaaacttaatttgaatttattcagtctacctggaaatgattgtaactgtctccctcaggaagaatgaagatcaaaataaagattatgcaaaattattgaaataattacattttccatatttatgtattcaccccttatattcattcgacaacaaaaagttattgagtccttactatgtcttatgagttatgagtattgataataccaagacaaataagacacagttttgttcctattatattggagcagacagataattaaatggatagacataaatatacaaaa

SEQ ID NO: 341367 - DNA, 772 bp, Homo sapiens
gtctctgtccatatcaaataacgatcaaactcatgaaaattacttctagccacaaatcatcaatcatcatgtccagaaacctatcctgaattctcccaactctcaaagctgggtgttactctatgtgccctgcaatagcagacaagaggctgatggctccattaccagggagtagctaagccagaatctgattcccaagcccccttgctcatgtgctctctcagaatccctgctgctccctgctgcctgcctgcctgcctgcctgaaatgtctcacacccttctctgcctgaactctgcttattgattatctttccaatttgaacctcagctcttcacagcctctcctgacacctatgcttctgggaacaagttggttgctccatcctttgtgatccccaaacactcctttagtaactttatgaaagcactcacactgcagtttagttattcatgtcttccccagcagacagcaaaggtaagccctgggtttattcttccatgtacctctagtacctggcacacagcttatcaaaaaatatttacctaatgaatgaatctccttagtcatctagttcaactttttcctctaaggtttatccttagaatgtctttacttgttccagttgaagactgattcccccagctggactttagatggcctcttgtttaacgtcctggtactgagttgagctttcccacatctaaggagagccaggctggtctcttggggtctcctccaggtctcccaaccttagtctgtttggagaaga

SEQ ID NO: 341368 - DNA, 565 bp, Homo sapiens
cccataacttgagaaaggaatctcaaacagggaatagagttcctcatctctactttgcaccaccactacactatgattcttctgattttaaggaaagagaagatgcacaccctgctaaattacgtagtctatcctctctgccgagtcaccagcatagaacactttctaagtcttcacacaagagaaggagcagctggtcagtgatgattattcattaactggacacaggctgccctggagccaggcactaagcttacgaaagggcatctgtgctgacccagatactgctgatggtcagacccggagcaagtcagcaagctatcctgcctgccctccacctctggcctgcagcaccgccttctactgcctcaccctgccggtgctcaggagctgctcgagccgaccctctgtgcaatgaggcctggaaagtttagctgacctattcaaggtcatgtaacttgttagcagcatacaaacactggaagctttctatttatgtatgcacttatttttgctttcttatctagcacataacccatggtaacaagctcatctctacatatct

SEQ ID NO: 341369 - DNA, 637 bp, Homo sapiens
gatgtggaggaaactacaagaaataaatggaaagactgaagagctgggaggcatctgagctgtcacatgtggagaaattggcctttcagggagataccttctatattttagcaagagggacgaaggggagaatgggcttgcagaatttgcagtgaaattttctcatgtttcctctgtgatggtttatattttctttacaaagaatttatctgtggtctggtatagttatcaggaatggtagagatgggcaaatagcacgaggggtaggcatctaaaatgaaaacatttgttcagcagttatcccatgccaggtactcaactaagagccttttacatccatcattccattcgttgctctcattaacactatgaggtatatattctttcatgatgcctgtaacagtttcctagggccataggaaaataaccaaataccacagactaggtgacttaaataacagaaatgtattttctcccagttctggaggctggtggtccaagagcaggtgtggacaggctggtttctcctgaggcctttctccttggtctgtgggtggctgccctctgcgcatgcacatccctggcatctctctgtgtgcttaatctcctctcctttaaggatacccgtcagactgaa

SEQ ID NO: 341370 - DNA, 882 bp, Homo sapiens
  misc_feature (16)..(16): n is a, c, g, or t
  misc_feature (21)..(21): n is a, c, g, or t
tggcgttctagaggancccanatgatggtccacctctacaaaaaaacaaatttttttaattagctgggcatgacggcacatgcctgtagccccagctactcaggaagctgaggcagaggactgcttgaacccaagaggttgaggcagcagtgagccatgattatgccactttactccagtttgggtgacagggtgagaccctgtctcaaaaaaaggaaagaatgacagaaaaattcaaaggataaaactagtcaaatcatttcatttctgaaattaccggaactctgaaaaaaagacaaaaaccaaagttaaacatttcagtcacttaagagtagaaaataatggcagtaaccaaaatattcatataagggttaatgaaaacctgtaacgtcaatttaatatttttaagaaacgggtaggctgggtgcagtggctcacacctgtaatcccagcactttgggaggccgaggtgggtggatcacttgaggtcaggagttcaagaccagtgtggccaacatcgtgaaaccctgtctctactaaaaatacaaaaattatctggccatggtggcgtgcgcctgtaaccctagctactcaggaggctgaggcaggagaatcgcttgaactcgggaggcggaggttgcagtgagccgagatcgcgccactgcactccagcctgggtgacagagtgagactctgtctcaaaaaaaaaaaaaattttttaatttttttattgaaataagattgccaaaagctagaaacgaaatagctaaattatgaaggagagaaatgtaggtttcctttcttttcctagattttcctctgataagaactatttacaaatgatgaagtccatgtattggcattaaaacattctccggacaa

SEQ ID NO: 341371 - DNA, 851 bp, Homo sapiens
  misc_feature (16)..(16): n is a, c, g, or t
  misc_feature (21)..(21): n is a, c, g, or t
tggcgttctagaggancccanatgatggtccacctctacaaaaaaacaaatttttttaattagctgggcatgacggcacatgcctgtagccccagctactcaggaagctgaggcagaggactgcttgaacccaagaggttgaggcagcagtgagccatgattatgccactttactccagtttgggtgacagggtgagaccctgtctcaaaaaaaggaaagaatgacagaaaaattcaaaggataaaactagtcaaatcatttcatttctgaaattaccggaactctgaaaaaaagacaaaaaccaaagttaaacatttcagtcacttaagagtagaaaataatggcagtaaccaaaatattcatataagggttaatgaaaacctgtaacgtcaatttaatatttttaagaaacgggtaggctgggtgcagtggctcacacctgtaatcccagcactttgggaggccgaggtgggtggatcacttgaggtcaggagttcaagaccagtgtggccaacatcgtgaaaccctgtctctactaaaaatacaaaaattatctggccatggtggcgtgcgcctgtaaccctagctactcaggaggctgaggtaccgggttcatctcactagggagtgccagaccgtgggcgcaggacagtgggtgcagcgcaccatgcgcgagacgactgcactccaccatgggtgatagagtgagactctgtctccaaaataaaataaaataaaataaaatagttggtagaattcagccggaaaataattctagtcccgggatttctttttaagaagctttgaagttagtgatcattcttcagtagtagtagcgcacggggatccc

SEQ ID NO: 341372 - DNA, 635 bp, Homo sapiens
agggcaatacctactacagaaaggatgggaggacttaggcacagtacaggctcatgcctgtactcccaacactgggaggccaaggaaggaggacagcttgagcccagtagttcaagatcagcctgagcaatacagcaagatggtccacctctacaaaaaaacaaatttttttaattagctgggcatgacggcacatgcctgtagccccagctactcaggaagctgaggcagaggactgcttgaacccaagaggttgaggcagcagtgagccatgattatgccactttactccagtttgggtgacagggtgagaccctgtctcaaaaaaaggaaagaatgacagaaaaattcaaaggataaaactagtcaaatcatttcatttctgaaattaccggaactctgaaaaaaagacaaaaaccaaagttaaacatttcagtcacttaagagtagaaaataatggcagtaaccaaaatattcatataagggttaatgaaaacctgtaacgtcaatttaatatttttaagaaacgggtaggctgggtgcagtggctcacacctgtaatcccagcactttgggaggccgaggtgggtggatcacttgaggtcaggagttcaagaccagtgtggccaacatcg

SEQ ID NO: 341373 - DNA, 736 bp, Homo sapiens
acagacatgtgccaccatgtccagctaatttttctatttttaatagagactgggttccaccatgttggtcaggctggtctcaaactcctgatctcaggcgatccacccaccttagcttcccaaaatgctgaacaaacccccctcccaaagtaaggcatgagtcaccatgcccagcccaggagtttttcttaaaatattattttcctttaaataatgaatgtacacatataacatttgataacaatataaaacagattatgattaggtgccaaagtgagtgagtggtgcatgaactatgttaggctttgaaataagagaggccatggtgagctgagcatgtcagagaggctttggcaagagcctggagctcctggagggcaaggactctgtccccttcctatatgtccccagtggcctgttggagcaggtgttcagtaagtattgattatagaaatgattgagacttgaacttaagcttgaagattaagtaaaatttattcaaatctgagagaggttttttctgttttaatgccatctattgtgctttgtctttgatttttggtcactgtgtgaactgttttatactcatctaatgaattaatttaataatcattcaatttctttaaggcaaaatggtgccttgaactcgaggcataagttgcatgaggccagatcattccactacctcaaactggtggtaaatgagactcctctcaaaaaaaaaaaattcaaaaaa

SEQ ID NO: 341374 - DNA, 682 bp, Homo sapiens
acagacatgtgccaccatgtccagctaatttttctatttttaatagagactgggttccaccatgttggtcaggctggtctcaaactcctgatctcaggcgatccacccaccttagcttcccaaaatgctgaacaaacccccctcccaaagtaaggcatgagtcaccatgcccagcccaggagtttttcttaaaatattattttcctttaaataatgaatgtacacatataacatttgataacaatatagctttgaaataagagaggccatggtgagctgagcatgtcagagaggctttggcaagagcctggagctcctggagggcaaggactctgtccccttcctatatgtccccagtggcctgttggagcaggtgttcagtaagtattgattatagaaatgattgagacttgaacttaagcttgaagattaagtaaaatttattcaaatctgagagaggttttttctgttttaatgccatctattgtgctttgtctttgatttttggtcactgtgtgaactgttttatactcatctaatgaattaatttaataatcattcaatttctttaaggcaaaatggtgccttgaactcgaggcataagttgcatgaggccagatcattccactacctcaaactggtggtaaatgagactcctctcaaaaaaaaaaaattcaaaaaa

SEQ ID NO: 341375 - DNA, 685 bp, Homo sapiens
catgcaagtggctgagcgaaaacccctctttgagtgaggaatccccagcacagaatgagagggtcttcatcttgcagcagtggcaagggtgagagtgaaaaggcaccctgcattctgtacctgaaaagaaatgcatttagaggctgggcgtggtggctcgtgcctgtaatgtcagcaatttgggaggctgaagcgggtggatcatgaggttaggagttcgagacaagcctggcaacatggtgaaaccctgcctctactaaaaacacaaaaattagccaggcgtggtggtgcgtgtctgtaatcccagctactcgggaggctgaggcaggagaatggcttgaacccaggaggtggaggttacagtgagccgagattgtgccactgcactccagcctgggcgacagagcaatactcttgtcttgaagaaaaaaaaaaagagaaatgcacttagatttcaaatttagtttggaaagagaaattataattgaatcacctaattcccaggcttgtaaatgttgtgtccttcaaagcttgaaagcaaaataaccacataaatatttgggagtggttcatacaagtaaacgtcaaatacttgagacattttggttgcttggaagcaaggtcaaaggaaatggtttgcatatggtttagctagaagctcttattttggcagattcttgaggta

SEQ ID NO: 341376 - DNA, 347 bp, Homo sapiens
cctatctgtgcaaaaaaaatgagaaagcttgttctaaagagaacatggagggtgtggctgaatacccatttaagaaaaagatcacgggtgcaattcatggacttaatcagacatctcagcagaagccaggaatagagatgggattatatcagcaaagacattgccagtttgaactaaagaggacagagaaagatgcagagaatgaaggaaagctgttggacttcctggattctgtaagcaaatatgtgctacagtggtccctcccttatccatggggaatacattccaagacccccagtagatgcctgaaaccacagatagggcgagccctgggatcctatgttttc

SEQ ID NO: 341377 - DNA, 208 bp, Homo sapiens
ttggaaaagtgacatttgaccatgaattaaatgtgaacactgcaaattttatttgactgtatgtaccaccagtaccctttttggtaaccaaaaaatttagttggtattttcttcctaaacagtcgtttgtaattctaagtctctctaagtaccaaagctctttaaattgcattcatttaatattaattcaataatttttccttaaatg

SEQ ID NO: 341378 - DNA, 342 bp, Homo sapiens
agatctaccctgttctttttaaatatcccagcataagtgtttacttttaaaatccagagctttactaaacattcacattcagggtattttgctttctctggatcagccattgcttgtgaccgtgactctccaatcataacagatttgctgagatacacacacacatacacacacacacgcacactcaaactgtagtgagaaagacttgtgtttaatccttctaaatttgtagatttatagggtcacaatgcagcttcagtaagtttcttatgtagtaaacttgagaaatatctaaattgagcttttaaaataataatagagaaataaaaaataataaaataa

SEQ ID NO: 341379 - DNA, 278 bp, Homo sapiens
ataaaacctttacatgcgtatgttttatcagtgcaagggaatagtattttgaatattagcgataacagtgaacctttggagctctcataaatgggttggttttgagccgaactcatgaaatattattatcagtaagatttgtcattgaggtgtgctggtgaggctctgacacaaactgagtctatcattttgcataaattaatcagtctccgtaagcgtcagctttctcatctgtgaaggggacttgttaatacctatcttatattgtgtaaaatgct

SEQ ID NO: 341380 - DNA, 287 bp, Homo sapiens
ttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgt

SEQ ID NO: 341381 - DNA, 630 bp, Homo sapiens
ttttgtctttctcacacacaaagtttagtggtaatttcacttacaagtcttaccttaaaaaaagacttgcctagcaacactgttcacatggtttaagaatgagtaatattagtcattatctgactgtcatatgcacgccagtaggctccaaaccattagcctgtactaaagacagaagtaaagcactggccaggcacagtggctcacacctgtaatcccagcactttgggaggctgagacaggtggagcacctgaggtcacgagttcaagaccagcctggccaacatggtgaaaccccgtctccactgaaaattaaaaaaatcagctggatgtggtggtgggcttctataatcccagctacttgggaggctgaggcaggagaatcacttgaacccaggaggtcgaggttgcagtgagccaagatcgtgccactgcactccagccagcctgggtgacaagagcgaaactccgtcacaaaaacaaacgaaaagaagtaaagcactatacaatcctatttaaatctaacagatgttataatgatctctagctactcaggagactgaagtgtgagaacaccctgagcccaggaatacaaggccagcctgggcaacacagcaagaccccatccct

SEQ ID NO: 341382 - DNA, 467 bp, Homo sapiens
gaaatcgcaaaatacaacgttttttaaaaagcacatgaatagcacaaacatcacaaaatccagaaaaataagttattaattaactgcctttcacctctgtaacaattgttttctacatttttgggttgtacactttgattatctcctcatatgaaaaattttgtaacattttctctagagagattgaaaatataattcagttttctctctagcacaatggatggaaaaggaaagttcagaaagctttcttgaagcttcaccactcattactggtaatgtcacatctgagtttctggttcaggcagtgctcggaaaagaagtgggaaaactccagctctttgatatcacggcttatggacaccgatggctgctactatgtatatggtccacttttgttaggtctttactgcccagtaggaacaggaggcagcaaagtcgacgcggccgcgaatttagtagtagtaggc

SEQ ID NO: 341383 - DNA, 174 bp, Homo sapiens
ccactgcactccagtctgggtgacagagtgagactccatctaaaaaagaaaaaaaaaattcccagcttaatagaaacttcagccactctgaaaatcaaaatacgaagatgtgggatagtctctaagggcctagaaggaagaaattcttgttagcaatttatttccctttggata

SEQ ID NO: 341384 - DNA, 769 bp, Homo sapiens
ctgtcatgcagcacatggttagaactggaagtccctaagtgaagtaagccaagcacaaaaagacaaatatcacatgttcccactcatatgtgggagctaaaaaaaaaagtagatctcatggagagagagtagaatggtggttaccagaggctgggaagagtaggggagtagagagttgaagagaagctgatcaacaggtacaaatatatggtttgaaagaagaaataagacctagtagatcagtagggtgactatagtttacaataacctgttgtaaattttaaaatagctagaagagaataatttgaatgtttctagcataaacacatagagtgatgaatattccaagtacactgatttaatatttacagattatataaatgtatattagattatcacatgcatccctaaaccatgtacacctattatgcatcaattcttttttttgaaaaagctacttttgggctgggcacggtggctcatgcctgtaatcctagcactttgggaagctaaggtgggtggatcacgaggtcaggagtttgagaccagcctggctaacatgctgaaaccccgtctctactaaaaatacaaaaaattagccgggcatggtggtgggcgcctgtaatcccagctacttgggcgctgtgccggcacgacgccccaagtgcatgtcagttgtggagaaaacatagcaaaaagagccgtacgccctttacagatactaatgtcaagaagttaaacctctcaggttcaacctgtgataaaagaa

SEQ ID NO: 341385 - DNA, 144 bp, Homo sapiens
ccatacacggatgccatcacttacaccctgtaatttaataacgcagagccaattactgatcaatgttattttttaaaccaatgagaattcctgaaagacaccctttgtaatcactcctccccgatttatccttttgtctttaaa

SEQ ID NO: 341386 - DNA, 582 bp, Homo sapiens
gccaaaagtcttaagggtcacccatgactattttctcactccccaaatctatccactttatctggagaaaaaaaaagtccagaatctaatcccttctccccattttccttgttcccactgagctgtccttttctctgccctggattactgtagtgtcctgctcactgcttcactggtctcccttggtttccctacaaccatagtgattctttcaaaacatgagtcaaataatatattccttagagtaaaagtcaaagtcctaacaggggcctaaagtaatttctgcaggcaaatcctgtaaggcctatttttatcaatctcgtgagctaagaatggtttttacatttacagagttggttaaaaaagcaaagtatatgaggcagagaccttatatggcctgcaaagtctaaaatatttactgtctattcctttacagaagaataaatgccaactcctgccctgagcaatgaggcccatgactttatgatcttgtctcctaatactcttcaccacattggtctcctttcctcatgcactccagtcatactcctgcctgttggagacctttgcatttggcttttt

SEQ ID NO: 341387 - DNA, 138 bp, Homo sapiens
acagaaagatgaaaatttgaactgctttaaatatattaaagaaattgaattcacaatttaaaactttcccaggaaaaatcaccaggcccacatggtttcactggagagctctatcaaacatttaaagaagaaattata

SEQ ID NO: 341388 - DNA, 6482 bp, Homo sapiens
ggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggca

SEQ ID NO: 341389 - DNA, 6587 bp, Homo sapiens
ggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggca

SEQ ID NO: 341390 - DNA, 2986 bp, Homo sapiens
cagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggca

SEQ ID NO: 341391 - DNA, 6624 bp, Homo sapiens
ggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccatgtttctcta

SEQ ID NO: 341392 - DNA, 1439 bp, Homo sapiens
ggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcactgtacattcgttctcaggtggtcttgtggctgtctttcggaaaatggttattttatatgatttgtcatggaatttgttctaataaatcattcttctatcacatggcagcacgctggagcctgtcaccttggccatgtttctcta

SEQ ID NO: 341393 - DNA, 258 bp, Homo sapiens
tgtggggagtttggcctccctttggggccgtggccagtgcctgtgtaaccagtggctaggccggtgtttggggccaggctggggagcacctcccccaggccccacctctggccagcagctgcctgggagctgggaggggctttgaggcctgtctggcccctgctgccccgacttcctctgtgcagaacctgccgtctttcctgccggctgcaggctgagccagacgctggtgaaggacgtggccatcctagcccagga

SEQ ID NO: 341394 - DNA, 626 bp, Homo sapiens
tggagtgggatcccgggaggcaggacactggctgagagttgtgtgtgtcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcgtcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatggggtaagtgtgagaggccctggcctggccttttaacagctcgacccttcagccctggcccctccctctcagttctggctcctcccccagtcatagcccctccc

SEQ ID NO: 341395 - DNA, 6785 bp, Homo sapiens
tggagtgggatcccgggaggcaggacactggctgagagttgtgtgtgtcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcgtcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggca

SEQ ID NO: 341396 - DNA, 6371 bp, Homo sapiens
cctgtgcgcatgcggcgacggctccctcagctgcccagtgagagggctgacagccctgcgggcccagagagcagcaggaggagtgggcctgggccaccggagctggacagtgagcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggca

SEQ ID NO: 341397 - DNA, 6358 bp, Homo sapiens
ggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgctttggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcgggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccatgtttctcta

SEQ ID NO: 341398 - DNA, 233 bp, Homo sapiens
cctggggcccacggtgccggccctccctcttgcagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggcacggtgcccactaccgccacggagctgggtgtggggggagcaggggcggggc

SEQ ID NO: 341399 - DNA, 1876 bp, Homo sapiens
gaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaacctgcaa

SEQ ID NO: 341400 - DNA, 1375 bp, Homo sapiens
gaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatggtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaacctgcaa

SEQ ID NO: 341401 - DNA, 1500 bp, Homo sapiens
gaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaacctgcaa

SEQ ID NO: 341402 - DNA, 2096 bp, Homo sapiens
gaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtaacgtgtacgacgctctctgcacagcgccaggtcccaatcccggtgttccggctcagcacggccacagcgtttcccagtttccattgcgtttctctttctgaactcttcttgcccctctcctgggaagctccccgattcttcttggcccttccttcccttccacagtccctctccaccctaagcccagcgggcccgcctcccccctccttcccggcaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaacctgcaa

SEQ ID NO: 341403 - DNA, 1528 bp, Homo sapiens
gaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtaacgtgtacgacgctctctgcacagcgccaggtcccaatcccggtgttccggctcagcacggccacagcgtttcccagtttccattgcgtttctctttctgaactcttcttgcccctctcctgggaagctccccgattcttcttggcccttccttcccttccacagtccctctccaccctaagcccagcgggcccgcctcccccctccttcccggcaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtacctggggtatcaaacaggtacacgcggcatctggggacgcagccaaactcccccgccactccctggccgcccgtctttccagcgcccacgattcagtgctgggttcccagaactcattttatcagacatttgcatacgcatatatcc

SEQ ID NO: 341404 - DNA, 387 bp, Homo sapiens
tgaaaggatgtaaaaaaaacccatacaaatagtaaacaaaagagagatgaggtaactatactaatatcagacaaaatagactataagtcaaaaacgattagaagagattaaaaagtacattatgtattaataaaaggataaattcatcaataatatgtaacagttataaacatatatgcaccaaatatcagagcttcaaaatatatgaagcaaacactggcagaattgaagggagaaatagatatctctataataatatatggagacttcaaaacaccactttcagtaagagacagaaccactagacagaagataaatgaggaaacaggacttcaacaacaccgtaagccaattatacctggcagacatacacagaacactccatac

SEQ ID NO: 341405 - DNA, 3693 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaag

SEQ ID NO: 341406 - DNA, 4744 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagttttt

SEQ ID NO: 341407 - DNA, 2708 bp, Homo sapiens
tgtatttttagtagagacggggtttcaccgtgttagtcaggatggtctcgatctcctgacctcatgatccgcctgcctcggcctctcaaagtgctgggattacaggcatgagccaccgcgcctggccagcgctctgcactcttttactggaaagtgggaggagggctgagacttctgaattgtaatttttaaatctacctcctgttagtcaacaagcatttacttaataccaattaaaatcgtatgtggttttaaaactataccaattctagtaatatatatatgttgtaagagacagtgaagaatttttaccgagtaggaatatggttgttgatttttgttttcattaacttttagggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagttttt

SEQ ID NO: 341408 - DNA, 4449 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagttaattatactacataaaatctctagggggtgcccggtacctcaatttgccttatttgaagttacattacaaattaatt

SEQ ID NO: 341409 - DNA, 500 bp, Homo sapiens
ttttttttgattaagaattatttggtgtttttttttcttgtaattgggtatttcataataacttctcttaattttaggaaagtgaaaaaactcttatgatgaacacattatataagcttcatgatcgattggcacagcttgcaggtaattgttttaacttttatagttgctaaaaatgttttgaaaaatgtatgtagcatgttattagtagaaaatatttttccaagtccagtgttatatttgtgaaatatttttctttagaagttttcattacctatacagagtgatttttgatttttacatatgtatttaatgaaggcttttttcctgcctgccatctgtattagaggtaatatatatatataatatagttataaagttgatcaaatttctttattgcatcagtggtaacaaaaaatctggaaagcttaagtatcagaggaattaggtaagcagtgaattaactaaaatcttggattaaatatacaaatgcagatttt

SEQ ID NO: 341410 - DNA, 437 bp, Homo sapiens
ctggctcctagtaaaagcatgcagtgaatattttttgaatgaactgaatgattgaatacctttcaacaaactagaacaatgtcaaatagtaaaactaacttgttttttgtagcatttcatttagatagaagaaattcaccaccaaatagtttgacaccgtgtctaaagattcggaatatgtttgatcccgttatgtaagtattatgatcaggggtacatgtaactcttattctgaatatttggctggaaaatgcatgatattcttataatggtgtgtctgtaattgaaaatgtttttcttctgaatctctaccacagaaatgttatgtttttctctttcattaaattccaagcaaagatttggccaaaggacactaatgtataaagatttgtaaaacttttataaatctttgtattccttatgaatcgtcatagcag

SEQ ID NO: 341411 - DNA, 5117 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagtttttaaaaaaaaaaaaatatcaggtgtcctaaccccaacttaccttcatgggacgctatttaattcgcattggccttatgaatccaagcgtcggaattggataaacctttcatatccttaacttataccgtttcaattatcttctatatttgctcactttcttaattttcgtatagctccataagatactgccctttaaacaaattgccacaatcgccaagtgttacagtgatatggcgagcattaaaattctcgtcaaaactctatataacgtctctctaattctacttatttattcctattgtgacccaatcagcctaactcttttattccactgctttattcgagatatggttctgtcttcttactctattccc

SEQ ID NO: 341412 - DNA, 4470 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttatttgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagttttt

SEQ ID NO: 341413 - DNA, 374 bp, Homo sapiens
catgctatgttcccctcaaaatgttctattcacttttcttgacttgttctcctacctgtacttcccactgtctcaactctctttctaatctctatgtggtcagataccaccacttccaataccagcataaaaatgatttcccccacgaagctttccctcattcttttaaggaagaagtaatttctccctttttgaaccactgtgacactttataaaacattacatcttcattagtagtatattcattcctgaacagaccatataccatacaaactatatcctctctattgagatagaaggccttgtccatagtaccaaccataggattttgcttatgataggtgtttaagaaatgttcataggctgggcatggt

SEQ ID NO: 341414 - DNA, 277 bp, Homo sapiens
tgccctgtgagagcttccttaaaattaattattttgaactctttgtcacgcagttcatatatctctattttttttgtttgtttgtttcagctaatgagaaattgtattattgtggtgatgttatgtctccctggcttttcctatttcttactgccatatgtttatttctacacatctgaagtaagggcttattccagtccttgcagactggctttatcaggtaaaacccttcagcagtcagcctatccagggattctgagcatgccatctgccaagg

SEQ ID NO: 341415 - DNA, 2156 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341416 - DNA, 820 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcaacagctttcactcctggcgcaagcagcttgcagaacaaacccgcgcaagtttcccaaaacaagtgtagtgggtgcgggctgagcccattggattagggtgagctggtgggaatgacccccagagatttattcagaaagcttcccagacaaaaggccactggggctaaccacggagcggcaagacgcaggagggaaagactagtgccttgagggaagctggtgaacgcccagaagtagctcagcaaataccggtagtgtggcatcccacggtggggattcgacaggtgcaagcatccctgggattctgggcctggacatctgccgatcgactccaacacgatctccatggta

SEQ ID NO: 341417 - DNA, 2356 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataaagaaaacaataaccataaccacctccccgtgtctgtttgcaccaggagcacctgggactgggaaggtcaaggggagggagcacacactgggacactggcttccgggaagcccatcttcctttcctttcacagctcttacccttttttttttttttttaattgcacagcagaaataaaaacaaatctgcagatgaaaaaag

SEQ ID NO: 341418 - DNA, 2504 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataaaaaaaaaaagaaaaaaacacaaaaacaaaaaaggggggggggacacaaaaataaccccgggggtggcaccaaatcgatgctgcgtcacccaggtgatatgtgataaaaagggggccccatatgggggggcgggaacaaaatagatcagaggcaacagcgcggcgctagacacacgcgtcgtaggggaacaagtgtctgggggaactcgggaagaggcaacaacaaattgggcggggcacacatgtgcacaccatcaccgacagaagatacacgctcagggaaattaaacctcaagggctagtggtacaccacggccatggtcgcgggacaatgcgacggtaggttcga

SEQ ID NO: 341419 - DNA, 1173 bp, Homo sapiens
  misc_feature (35)..(35): n is a, c, g, or t
tcgatctagaggatcccgtgtcatcccccttcgtngtgttcaccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341420 - DNA, 1181 bp, Homo sapiens
gatctcgatgtgtgtttgagctgtagatctggacatccgtgccacagagccaggtaggtaccactctggtcaaagatcagtgactttacctcaaagttgttatccagctgcaaagtcttaaagttcttaagcttgcgcagaccccagagcttgatagaggaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341421 - DNA, 904 bp, Homo sapiens
tggtctctcacctgttgtgagattgcatatccgatagcctcttctatgtagatcttgcagcaaggactctcagatcaagatctgtgacttgatggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341422 - DNA, 909 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggagggcttgtgcagggttttgtaagcagtgatctagtttcattaaaaaaagaaaacaataa

SEQ ID NO: 341423 - DNA, 985 bp, Homo sapiens
ttggttctaatgcaaatcaacagcacgcgcactggaggaggtcggcggggagcaaggctttgtctatagcctctgattatacttcagggtgtatatcctccgtgcttccctatatccattttgctatccctgtaccctccttctccttttgtttggcaactgttggcatccatgccttgtggtcaccattgattcctggccctgtgggtttcatgtgtttacccaagatgcttttcttcgtggccatctatgtgaccttttcctttggtttaggatcggtgctttgacccccgcgtcaagtctgtcactctgttgcttggttccagtatgcgttgtgacagctcttgtggcgggtgttgttctctctgtctgtctgggcgtcatgttttgtagctgtgctgttattgtctgcatcccactcatcctgctagcctttcatgtatgtccgggatgtctgttgtgtctgtatgggaggcgtgggccggactccgggttggattctctttttatgtcgatgtcgcctgctccttcggtagtgagagctgtgttgtttgttgcttctcggtaccactctctccgcaatgtacttctcgatgatgccgccgctcataaacatgattagagacaggggatacacatcgctgctccggcaccggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341424 - DNA, 320 bp, Homo sapiens
actatctcctcagtcaggagactaaaggaaaaggtagttccatagctggaaagcattctggggccagtacagaactggcttagggtcaaatgtcttgctttctgctagttgagtgtgaggatgcctagtcttgttggggctaatagcagatgaggaatcctctaggcccaagattgccttcactccaagctcactaccagccttttctctacagtctctaacgaagtgccggagcacccatgtgtatcccctgtctctaatcatgtttatgagcggcggctcatcgagaagtacattgcggagaatggtaccgaccccat

SEQ ID NO: 341425 - DNA, 854 bp, Homo sapiens
  misc_feature (59)..(59): n is a, c, g, or t
  misc_feature (738)..(738): n is a, c, g, or t
taaaaaaaaaaaataaaaaaagaacaaaaaaagaaactaacggctaggtacgaggctgngtggtcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagncatgtgctaacactggagcgcatgagagacgggaagactgtgctgaggagctggtgagcagaaactcacaaaacgggggggctccagtgggtgcaagtgcacatcctgatcgcctg

SEQ ID NO: 341426 - DNA, 1985 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341427 - DNA, 1918 bp, Homo sapiens
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacaggtagaggctggtcctgggctcctgggatctctctaggtgcccaggcccggagggaagcctcactgggttaggaatttctagggcttgcatgaatttacctaagcagctttctgttaccacctgaggcagagctttatgactaaggaagcaactgagtcagactgcatggcagtagatgctagtgcttgttctgccacttccatgccctgtggcattgggcaggttactaaagggagagaaaagtccctctgaagttttgataactgaatctaaaataaatgaacattagacagtg

SEQ ID NO: 341428 - DNA, 1008 bp, Homo sapiens
ggtgcttgtggcacctggccctgaaggtggagagacactggctgtgcgtgtgtgatatgatggtgtggtctggggggtcccgctggctgtccttcctggaaggacgtgagggacatctcaggtaggagtttggtgagccccattttcttcctctcatgatctgtgggtgacgtattttactacccaccgccactgtaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341429 - DNA, 821 bp, Homo sapiens
tgctagtgatgggaaccgagtggccagggaagttggccacactagtacgttccttcaagtcccagatcttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341430 - DNA, 1044 bp, Homo sapiens
ccgttctctccccttgttcttggtctttgttcctcgtgtgccttgcccccttttgctcttccattcggcttctctggtgtgtcgcgttctatgggtggtgtttgtgtttgtccctgtttgtgctttttctgatgtcctttggtgtgctcctttttcccacctggctactttctgtccctgtgggtccctttgatctcctcctcttgttgaactaccttagtgtcgggctttttctggctccctcttctctctttcttcctcttgtttatgttgggctttttctggtgtgctctagctcttgtttttttccttctccttgtgtttccttgcgtgtctatgtgttttttatctctcttgtttgggtttttcccttcctctgttatgtgtctctttgatgtgttactctctcggtattgtcgtttcctgtgtacttttgtgttctgtttcgtctctcttgtatctttttgttatgctcgtcttctcagtccatgttgttggatttctctgtttggtcatctctacggtgcattaatgtctctggtctcaggagtccccacgtattgtctcgtcatcttgtgcaatccccacgctgtgatgccatcctttcccggtacttccctgagctcttctgtgctctcaccagcgtcctcatggccctgtcttccctctcgtcttgcgctcccgtgcgttagcacttctggtcttgtgcggacggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 341431 - DNA, 479 bp, Homo sapiens
aaaaaaaaaaaaaaaaaaaaggcagaaatactactatttgcagatatgatggcccacgtggaaaacccaaatagtcacctaagacgttctcagaatccataatcgcagcaagtagctatgtgtatgatgaatagggaaaaaaacactttctgttattccaacaataattggtagtaacctgagcaggggtggtgatgggaaaatcgccttatgatagtcataatacatttcttagaaataagaatttctaacaatttgagcaggacccatataaggaaaactacagctctaccatgattgaggattggggaactgaacaagtgcagtaccaaagaaaattccatgagatctggtaaaatgtgtcaaaatcctaaactttttcatccgtatgaataaactaataaaaataactaagatgttttagaaaaaaatgattttcatatcagatatgaaaagataaagtgtcaatataaatattg

SEQ ID NO: 341432 - DNA, 603 bp, Homo sapiens
gtgcagtggctcacgcctgtaatcccagcactttgggaggccaaggcagacagattacttgaggtcaagagttcgagaccagcctggacaacctggtgaaatcccatctctaccaaaaaatacaaaaattaagtgtgaatggtggcatgcacctgtaatcccagctacttgaaccgggggcagggggacgcagggggtgcagtggaggttgcagtgagccaggatcgtgccactgcactccagcctgggtgtcaaagtgagaacatgtcttcaaataaataaatcataaaaatacaaataaaacaattttttagagacagggtccagggtctcacctattgcccaggctggagtgcagtggtgcaatcatagctcactgtagcttcatactcctgggctcaagtgatcctcccacctcactcttccaggcagctggcactacaggtatgcaccaccacacccagctaattttttaattttttgtaagggtggtggtgggggggggtctcactgtattgcataggctagtcttgaactcctggcctcaactgatcctccggccttagcctcccaaagcactgggaaataaactgatttttaatg

SEQ ID NO: 341433 - DNA, 259 bp, Homo sapiens
agaggaggtggcagtgaatgaggaatgacaccagcctgccacatgtgccaaaagcaggatgcatgggtggcaaggtggagaagataaaccacaccagcctttgccactgttgatcaccttcaggagaagagaaataaggaaatattagatcatgacttggaaaatgtatcaggcaggactttgtgcaagccctttggaactcccgctaatctaaatggggaagacaagacactgagaacactaagcagatccatatctc

SEQ ID NO: 341434 - DNA, 294 bp, Homo sapiens
gttcgcaggcaatcccaagagagtttatgttggccagtggtgccctaaggtgccagagtctttcaccctcccttttcctggaatgaccttgtaacttggacttcctgcttcagatttgcctgggtatttgcagttcctccctcagtggcacaccaagctccttcctaccttaggggcttctcagttgctgttctttctgcctggaatgctcttcctttataaatttccatgactactttcttctcaagagtcagctcaaatgtgtcctcagaaatacgttccctggccacctta

SEQ ID NO: 341435 - DNA, 619 bp, Homo sapiens
tgtcctgtctacaaaaagtaccttacagatatgttcatttgataaaaagaccaaaaccagcccacctggtgaagttcacatgtgaaggtgacacacatagagcctgtggcataaaacacagaatttatttaggcagaaggaaacaggaggcaatggctgctgaagcaagaaggaaaaatgtttttataactaagtagtatataaagtacttttagtactatatatataaagtataactaactactactactactactgctactgctactgctactgctactacgagattactttttcactgtcaccaaaagttttgaaaaatacgtttttatattttgaaatatattttgaaaaatatatactttattatcatacagtaggttagttatttttaaatgttttcataattgttttaaacctatattttaaaacaatttaaaattggtttctaataaggtaaatactaatagatataatccacataaacaaaagctctttgagtttctcagtaacatttaatagcgcaaatcttatctttttttccttttgcttttttaaatgtttttctctcaagccactttgtctaagaatactatgtcggtcaggtgcagtggttcat

SEQ ID NO: 341436 - DNA, 784 bp, Homo sapiens
ctaacataaacagtctatttctactgccttttacataaactttagcacacttgaagtagagagccctttcccaggataacgtttcctctgcctgttatgcgatagaacacatcccaggcacatgcctgtgtattcagtgaaaggaaagaacgagttcggaattcataaagattcaaagtgttaatttcagattttccataggtttgaggaatgttccatagatctgatagcccttttcacaaccctccttctctctaatatgtggcctttccccactttgctgtgaaagctttaagcattacttctgcatgctctggtcccaacagcattaaatacatgttgctttgggtttgctggtatggtgggctgccacaagtttgactactaatgtgtgcttttttccctcaatttgcttagtaatcagaacttttgtgcttctcggcatagtctatattacttcttatctataattcctgaatataaaatatataaaatttagagaaaaagcaaccaagtcagagaggtagatttaattttgggataaatacctgaatctgtcatagaagggaaaagagaaaagtaattggctataatatacaaagaactaaaaaattttaaaaaaagatacagacatacctacacatatatacatacatagatacctatacatactctttatctcagattttgatcattaaaattcttaaatgattcaagcctttgctagtcttatctgtgctctcccaatctgtcattacgttaaggggaccttgtgttatggtac

SEQ ID NO: 341437 - DNA, 335 bp, Homo sapiens
aagccagcagtgactggtcaaacctttccaacaccacatcactccaatgctaatccttccacctccgctttccacatgtaagcatccgtgtgatttgatcagcctacctagataatcgaggataatcttcctattctagggtcaactggtcagcaaacttaattaccctttgccacatgcacagcttctgattaggattcagacttctttgtgggaagcgttattctgtgtactacgcagctccagtgaaattattttaatgatttctttctgatatggagtgtgtgagtgtgatgggttggggaaaggggaggaaagaatcagtttatccagcc

SEQ ID NO: 341438 - DNA, 481 bp, Homo sapiens
cagtcttaattcatttatgactactcagaaacaagcttttgtttctccctagattgcctaggattacctcctaaggaatgtagatcaaacttattgcacccatcctcctataatttaggtctgttttctaaactggaggtcaaaatccattagtaaattgaaagaagcactcagaaaaaggaaaaaataaaagagtagaaagaaaatatcagagtgcatgcaagtagtaagggtaagtgctgctttgggaaatgtttgtgtatatgtatgtgtgttgcagtgtaaaatatatgtccaacaatggattgtcaaaaaaagtttgaaaaacactagtatcttaccttagtgtgtattttctgtatttctatattttctgactttattttcaactcttattttcctgtattttgatttatctacatattttttatcctgcagtattatacacatcgctctgaaaactgttttcattctattctgg

SEQ ID NO: 341439 - DNA, 707 bp, Homo sapiens
ttcatcatgttggtgaggatggtctcgaactcctgacctcaggtgatccacccacctcggcctcccaaagtgctggggttacagcgtgagccaccacacctggctgggaattcacatttctaacaagtttccagatgaggctgcaagtcctgatggtacagggatggcactttgagaacccctgctgtgcagtgtcatgtgtcatcacctcatctcccttagggcagatagtgccactcccagcttaccaaagaagaaactacagcctccacaggccaagtgaccttgccaaggccacacagctggagggtgctagggagccaaactgcacctgctgcactgccttttgcccccagggcaatgtggctggggtgggtgtgacagcatctctccaaatttttgttccagagagggcagtaagtagagagggcaggcttggggtaagcagtactgggaggtggtcatagagtcactgttaggctaacagtcattccttgggtggccataatgttttaaagacactttcagcaaggcacagtggtgcatgcctgtagccccagctacttgagaggcttgcttgagcccaggagtttgagactggcctaggcaacatagtgagacctcatctcaaaaaatatttaaaaataaaaataagatacttttgcttctatctatctatctatctatctatctatctatctatctat

SEQ ID NO: 341440 - DNA, 479 bp, Homo sapiens
caactaaaggaaaaactgctttttccctccactatcccaatacttccgaccactaaatgtgcaagggattttcaaaccaagcaattctccagttcttggtgcacaataactaggtgctctataatccattcgattctgatactgtctacctggagttagcacagatgccatggattgagatctgtgtttagacccagggtaggcccatcattgccttccggcatgtggactgtgaactagaggcatccttgaaactggaaacaagggccttgtggggcaaaggccttctgacctgggcaaaggcatagtctgctgggagcagcaggagagatgggacagatagggcatcattgccagcaagatgcctcctgctcccagaactagatgtcttcaggagaggcaagatccagacacaggtttagaacaaaaggtgatgaactggaaccagccttaatgattgatgggagaaggtgctacat

SEQ ID NO: 341441 - DNA, 543 bp, Homo sapiens
atgtgggaaggtgtatgagtgcgtgtgagtgtagggactatgcagatatgagggtgtagttcaggtgtgaggctgggagcctgttgcctggattggagcagtgttttccaaggcctgagtgctacctgaacaggaacatccagcacaagcacgtgggaaggggcccccggcctggaagttgggcactgacccacacagatgcacaaggacagacatacccgcccctgtcctccctcttcctctcttctggcgtcagtggtttttaaaggagcctccgtgaggactgtttgctgtgcagttcccccacccccagcctgtgtctcttcaaacgcagtgctgccctccaggcagctttgtggaggctcctgcctcgaccatctgaaggcagatgggtgggcttggatccgctgctgccccccagggagcgaggaggcagctctgctccttgggcctgggcacaggctgagacagatggactgcctgtctcaacacccccgcacaggcaccccataccataggggttctagcgggtagcccccagtt

SEQ ID NO: 341442 - DNA, 317 bp, Homo sapiens
tgtatttatttttgataaaccccttggatcacacctgagtttacactaagatgagatgactcaggctggagtctggtcaccagaaaaaccaaccatgcaattagaggatcagggctctaagccagcccaatccagagaggggaaaggaggggactggaaattgaatcattggccatgtggttgtactcaatcaatcctgcctatgtaacgaaaccccaatagaaactggacaccaggctcactggagctttttggttggtaaacacatcaacgtgccaggcaggtgacacaccctagttccaagggacaagacacag

SEQ ID NO: 341443 - DNA, 132 bp, Homo sapiens
gattctgatggagaaattccaggttgagaaatgctacttgtaagaatgtatgaaatgataccacaaaagacacgtaactgttcgtctttagtatatcaatattgtgtcagttggtaacaattataaaagctg

SEQ ID NO: 341444 - DNA, 603 bp, Homo sapiens
catattagcaaacactgaaaacagtgaaggagctggggctggtaaggttataataagatacactgcaatgcagggcactaaataacatgcacttttaaaagttaacccactggaaaaagaaaagttcattttagctctcttgacaacactgctttccttccataataaggtcctttgtatccttaaagccctttccttcatctttttgtcttcatattttctgaaatgtaaagtttcctacatgacacaagacatggtaaaatgtcttgttatttctccctctatgtttattactgtcttgtgtgagattcaaaagaattttccaagtggaaccctgtcctctgctgggtatctcaggacgtagacaggtggcagtgggcaggtacagggacagacaaggagagtccctatactcatcttccctccatctgcagcccagtctgtgttctcttcttccagtgaacatgcttgggtacctaaaggaaaaggcatagctagaaagacggtacagaggctacccagaaaattgcatctcgttacagaaacgtcaggtgtcgtgctctgcaggggaccaactgctaacacagatacacgggcctccgg

SEQ ID NO: 341445 - DNA, 124 bp, Homo sapiens
aggcctgggcccttggtaggctggcgggtgccaatgtaagcttctctcagctgtgtttctgttcatttccctcccaccagcctgtcctgcatactttgtctggttgaattttagctgagtggcc

SEQ ID NO: 341446 - DNA, 333 bp, Homo sapiens
ggctgatcacatcttttcgatgccagagttggcttcctctccccaaccttaccctcaatcacacacaggttttcattagtagcacacatttgtggaatactgaacagagggagtttgacttagtctctaaaaagtaaaggggatcatacatggatggtcataaagagcctgtagacaactgactattgaacagaatgttttcaaaaggaaataacatattactcttgtgacaaggcagaggagtaagtgcatattatggtgtgacaatacttttagactgagtaaagcaaagattgtaccatctttctctcaattagttagctaagccatgtg

SEQ ID NO: 341447 - DNA, 266 bp, Homo sapiens
ctttgtctactgggtaaattatattcattatgcccactgctgcagcatgcataaaccaacacccctgcatggcctaatctgggactgatgggagaagtgcttgcaaaccaagatcaaggtgtcatttctctgctaatactgtctaacaagctgacccttacaaaaacgcacgtaaaatcaggcaggtttagctactgtgttgcaagagaaaccaggacctttctaaatagttctctccattaccatttattctctcaagggaaact

SEQ ID NO: 341448 - DNA, 193 bp, Homo sapiens
taagcagttgagtaaggaatgagaactgacccttaggtttagacataaaaagtgtctgtgaacctgacataagcagatacagtggaaggaaagctagactggagtgctgaagtatgaataggagaggaaatggaaacaattagtagagatagctcttgagaatctttgcatgaaagaagcagagaacggggta

SEQ ID NO: 341449 - DNA, 425 bp, Homo sapiens
aacccagctctttttatttttgtgtcttgcccatggatgtcacattttccataactagggtcagtctgtgtatgcacagttttcacttttgccattttcccttagcatttatgtaatcacagtttctggtggttgtattgttgtgccgtaatttactaagccattcagattgctacatttttggtttataaataacaccgtagagaatatatctgtatatgttattattaacttgaattatttccttcatgttaattcctagaagtggaattactgggttaaagagaataaatatattattttccaagagcgtcataccagtttacactgacaccaataatgaatcagtaaatccatttcattgaactcttcccagcatttgatattttaattttttttttgtttttccttgagaaagtgtctgg

SEQ ID NO: 341450 - DNA, 149 bp, Homo sapiens
tagctatcattactacaggatgaggccatgctcctgagaattgcttatgagtggtctcttgatttgaactctgcctggcccttgatgaccactctgcctacccagcctcaacacttcacactccagcagttcttttttttttttttttt

SEQ ID NO: 341451 - DNA, 243 bp, Homo sapiens
ctactggtccatatgagcgcctggggtccacagcccatcccaagaacttagatgccctgaaatatacctggaaagcatcaaatgtggtggcagaagctttgccctgatgatctaacaagtttctctacaggctgtgccctaaggtaccctgcgggggtgggccagagtagtcagacaggtcaggctctgggaacccctggatccaagcagccccatttgatatatttcgtagacctgggcctc

SEQ ID NO: 341452 - DNA, 627 bp, Homo sapiens
ctccaatttagccctgagcaaacttaagacatttatgttttcttaaatctaatgtattatatgcaaaaccttttcaaactatttacaaagctgaagcaccaagacacatgattctttgacttatttttaatgacttttaaatataatgagaaaaacattaattacgatgcaagtcatcatcctattaaaacatttcacttataatacaagcatttaagtatagtagtagtagttaaatctaaaaaaaaaacaaaaaattagccataaataatgatgaagctgccagtagttaacaacacacactcacaaataatgagataaatttaacggcaagcttccaaacaaaaaccttgtcattttaaggtgtcccacagcagaccggttatgacctcgggaactggcctgaaatcttgcctcctttcttgtgtaaccagccaaataacaacacctctctaaatctgtttctttataatggtgccaaccttatacggtagctgtagatattaattaagacactgcacctaggaaagagcctagcacacagtaaataataactcacaattattaaattttggaagaaatgttacacaaagcagcagccctttgacttttaaaaaaaaatttaca

SEQ ID NO: 341453 - DNA, 226 bp, Homo sapiens
ttcaaagcaggataccttttccatgctggagaaggtgaatctttgaaagtcggtaggagtgattaggtaaaggaggtgaaggagtaaagataattattctagactgagaaattatgttagtatcaggttatgaggttagaagaggtaagtaggcaactggtattgctgtgctgagaatttaaaaatctttattgaaggctttaaaagaaaagtggtaatagtaaga

SEQ ID NO: 341454 - DNA, 327 bp, Homo sapiens
aaagtttaataaaatcataatatttttactgtgtatgaaatactctaatatttctattcttgtccatttttactttgtagtgtttaactggcatttggtgaggcccaccatattgatttctttaccctatgtattgcaaaccacaatttgaaaaacactactttaagtcttacagtcaggaatgaattacaaggtcagaaaatatagcatgctggccagactggtggcctgtcaagtgttctgcccactttggcctcctaaagtgctgaggttacaggcataagcctggccagcatgctatattttctggtcgacgcggccgcgaat

SEQ ID NO: 341455 - DNA, 1279 bp, Homo sapiens
tccatacaaagaattaaaaatttgtttttcagtataattataaattaagtatcatggaactttagagactctcttgaatagtcagacacctcaaatattaagtccttaaatttcagttgttgggttttttgcttttatattttcttttctccacaggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagt

SEQ ID NO: 341456 - DNA, 766 bp, Homo sapiens
tccatacaaagaattaaaaatttgtttttcagtataattataaattaagtatcatggaactttagagactctcttgaatagtcagacacctcaaatattaagtccttaaatttcagttgttgggttttttgcttttatattttcttttctccacaggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaattaatcctgttggtgagacacatc

SEQ ID NO: 341457 - DNA, 707 bp, Homo sapiens
cctcaacaggacctagtgtgttgtttcccaccatgtgtccatggattctcattgttcagctcccattataaatgggaacacacagtatttgtttttctgttcctgcattagtttgctgaggataagggcttacagctccatccatgtccctgcaaaggacatgatctcattccttttcatggctgcatagtataccatagcatatatgtgccacattttctttatcctatctatcattgatgggcatttggtttgattccatgtctttgctattgtgaatggtgctgcaatgaacatacatgttcatgtatctttataatagaataatttatattcctttggagatatacttggtaatgggattgctgggtcaaatggtatttttgcctctagatctttgaggaatcaccaccctgtcttccacaatggttgaactaataatttacattcccaccaacagtgtaaaagcattcctttttctctgcaacctcaccagcatctgttgttccttgactttttaataatcaccattctgactggcataagatggtatctcattgtggtttgggtttgcatttctctaatgatcagtgatctttcctaatttttacaacacataatgttgagcttaatgatctgcaattggcactaattaatactattgatctgtaactggcactaattaatgctattttcaatagtcaatt

SEQ ID NO: 341458 - DNA, 459 bp, Homo sapiens
ttgattttatgtgactatcatcttggtgatttccttgactcacttttgctggattcttttcgtggatttcttgtcttagtttattctcttgtatcgatggagtatatcttactcctttaaaaaaaaaaaaaccaccctacatttaggatatacttgatggcccgttcatctgaaaatatcttaattctactctcaaacttgactcagacctgactggatatagaattctagatgaaaaattagaaatgatttttcctcagaatttgggaagcattaatcagtgacttccagattctgaatttgcttttaaaaagtcagatgttgttctggtttttgatcttttatataaaagaaacttgtgggatcttttcttgtgtctctgcttggaaatttcacaataactttcctagatgtacattgatttttatctgttttttttttctgagacagttttgctcc

SEQ ID NO: 341459 - DNA, 294 bp, Homo sapiens
gagagagacagcagcaggctaactagttgtctgttaagaacatccagagcaggaccagaatctgggccaggaactgagagacagattgggacaacggaacaaatctaccagggtactatcagatggaggaacatgtagtttgtggtcagtgacctcaggttctcacattcacggtgctgcatcctggttttcatttggggactgttttctggcactcccgcctgtctggaggtgagatatgcttgttatgacaacccttctgtcacaataaattggctggtgcattcagtgtca

SEQ ID NO: 341460 - DNA, 268 bp, Homo sapiens
ggggggtggaggttgtgtgtactaaaaatgaactcagatttaatgataattaatgatgaattaatgatacttaactcatagattaaacatctttttatgtccttgaatcaatagaaatttttatatttaatattcatcttgtgtcatcccaaacttcgctagtagatgcttcaagttattatcttgattcttcagatgcattttagtaatctttggactccttgctttctggtgttctaagtttatcttatctatttccagttctttt

SEQ ID NO: 341461 - DNA, 2875 bp, Homo sapiens
gaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctctgcatgctgccgggtctgcccgacaccgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccaactgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattatcttccaagataggaagccaagtgggtctaggccaggagatgggggggggcgggggcagctgtgtcatctttctggggcccaggaggatctgggctggtttgtctggggagacagacaggatgttgtggaggtggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagccggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgccaaaaaaaaaaaaaatagggtatccaaatatctagattctgatcccttttgaggtcctagaccctttgagaaactgatgaagccaggcacctccttcctcaggaaaatgctggtgtacaaatacacacaaagctcttcaggcagctgatagatttcccccagagagctattcaaggacttcctaaggtgggtggactgcagggttaggacacctgctatagaggtgacatttttccaaggacaagcagggactttggtcttgactgttctctgggtgcttaataaataatactaattatgcaaggagtctgagtt

SEQ ID NO: 341462 - DNA, 302 bp, Homo sapiens
ggtacagccagaaagcaccccaagggtgggcgccctcccatcctgcctgcaggcggtggcttgctggcatctgtgggaactgcccgtgtccatgtgctgagaggaatgacctgcaggaatgggtccctctgcacccgcttccaggactgcccgccagcgtgcaattccccatctgctgctaagaccttcctggatcaatatccctcatctgggtcatccagggaagcttttgcacgtggtttcacacttctcaattccaagccctgaggggctggttattctcctttctccccaccccaccc

SEQ ID NO: 341463 - DNA, 390 bp, Homo sapiens
tttcaaaacccaaacaaattttgtaacatttgttgtcaaaatcttacctgaactgacataaggcaatgtgtaatctttatttaccccacttagtgtgaatatccatgttttgccacagaagtattaatgtttttgattacagatgccaccccagcccccactggaggtgttatttaatagtaaatgtatttaatacattgtcctatgtaaaactgaaaaaatcctgaattcagaaacacatctgacttaaactgcttcaaattaacgatgcaggcctatactgatactattatcattctcatttcagaaataggtcataccaggcatgcctctctgttagtatattttttcactcaacaatatatctaggacatctttctttctttcttt

SEQ ID NO: 341464 - DNA, 1655 bp, Homo sapiens
taccttataaaatacatgcaaaaaactggttttagaaagcgttccctaaaattagtgtgtacggaaacttcaggtatacttctgctttcctccgcaaaaccacccctttttaaaaatcgaaagtgaaattagtttttttttctgttagtgactaatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctccgggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaaactagagctgagcttttcaaagtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttataaaaaaaaaaaaccaaaccaacaaaaagcacaaaacac

SEQ ID NO: 341465 - DNA, 1618 bp, Homo sapiens
taccttataaaatacatgcaaaaaactggttttagaaagcgttccctaaaattagtgtgtacggaaacttcaggtatacttctgctttcctccgcaaaaccacccctttttaaaaatcgaaagtgaaattagtttttttttctgttagtgactaatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctccgggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaaactagagctgagcttttcaaagtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttata

SEQ ID NO: 341466 - DNA, 669 bp, Homo sapiens
cagcctggagagcctcagtccctgtagccccctgccctggcacagctgcatgcacttcgtgggcagcgctgtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttata

SEQ ID NO: 341467 - DNA, 117 bp, Homo sapiens
ttgccaaacaaggataggctgtgcccatctcaggaactcagcttgaatgttgggttaattttagccttacacagcatcagcatggctcttcgacccttctccctcacctctttcatc

SEQ ID NO: 341468 - DNA, 488 bp, Homo sapiens
gctggtcttgaactcctgacgtcaggtgatccccccaccttggccttccaaagtgctgggattacaggcgtgagccactgtgcccagaggagttaatttttttatatagtgagagatacggatccagtttcattcttctacatgtggctaaccagttttcccagaatgatttattgaataggaagctttgtcaaagatcagttggttgcaagtatttgtctttatttctggattctctattctattccattgatatctaagtttataccagtaccatgctgtttttgttactatagccttgaagtataacttgaaatcagattttttaaaaatttttttatttttatttatttatttatttttgcttagaattgctttggctatccagctttttttttttttggttccatatgaatttaggatttttttttctaattctgtaaaaaacgatattggtatcttgataataattgaattgaatctacaga

SEQ ID NO: 341469 - DNA, 341 bp, Homo sapiens
tttctacatcaacaccgacaatgtcaagcagagcctgtccaagaaacgcaaggccctggccacttccgtgctggacatccttgccaagaacctgcataaggaggtggatagctcctcagcaacccagggagcccaccaggagcacccctcttggaaagcgccgcaggatgttgtggtggaggggacagttacctgtcgggagatgctggagaccaaggaggaagagcaggtgagggaaggcaagggagcagcatgctgccctccccagcgcctcctcccactgccagatctgcgaggagttccgcagcatcagccgcaagatctatgagaagcccaacagc

SEQ ID NO: 341470 - DNA, 361 bp, Homo sapiens
taaattttttgtagatggggtctcactatgtcatccaggctggtcttgaattcctggcctcaagcaatcctcctgcattggcctcccaaagtgctgggattacaggtgtaagccaccatcgccagcctcattttaaaagaagtgtcatattttaaaagaaatattgacagccttcttttttcacatctgtgttccaatacttatttgatatagtatgtaagtggacatattctcaacacaagtatctatacaaaggtgactggaagagatgatgtagacataaaattattggattgagcttctaattgttgtttataaatctaaaaataataagtgttttgcactttatggaggaaaaaag

SEQ ID NO: 341471 - DNA, 411 bp, Homo sapiens
agtgaggtttcgtctcaaaaaaaaaaaaaaaagaaaagaaagttttcaattttgaaatttctactgctatcagctttttatactgaatattgtttatttttgccttctcttctttataaatcagtttatgtcattattactgttatatacaatatatgttttacataagacaataaatgtcttttctctctagttgttttgtctccggtgttccatgatagcaccatgatataataagaggcgggataggccaggcatggtgcctcatacctgtataatccaggactttgggaggctgaggcaggcgtgagccaccgcacctggccttatctctgctgtttaacccattcactgaatttttaattttaaggaccatatttttcatttctaaacacttgattcttttcccaa

SEQ ID NO: 341472 - DNA, 82 bp, Homo sapiens
gctgtgaatatgttttatccagtcctggaaattctattttcttggccatatgacccagtcctaggcaatgggtggggagctt

SEQ ID NO: 341473 - DNA, 540 bp, Homo sapiens
ctaatcgccctctcaggtgaaactgacctttcctcctcacctcttctccttcagtaactctccccagcccaaagctgactccttggtaggcaaaggctggtcagtcttccttccttattcactgaataagccatgcccctttgcaggcctccagtctaatttgtgattctaactaatgaggtggggtctgaggaacttgaagaggccctttctattttattttttattcttggtttccaatagttggagaaacaggatctggccaactttctctagacaaaggctgtatgctaggtttttcattttcttagctgaaatgattgtggcaaatcacttaaacagatacaaaaaggaggtctctgtggacggacacctcatagactaaaagatcagccacagttcatcattttagacatatattgctagagccaaaataagtatcaggaaggtttcaagtttctctggaaaagaaaatcttttggtaacaattctcaaatcgaccttgatctctcaacttccagacactactctatgatcagt

SEQ ID NO: 341474 - DNA, 712 bp, Homo sapiens
  misc_feature (193)..(193): n is a, c, g, or t
ttgtatgggcacagaaattaaaacaggcaagtaaagtatttcttcggaaaacattttatcaaaccaaatgttaaaaagactttccttttgtaaaactggattagagaacgacttttcagtgggttatctctaggatgatcagtagttcagcacttaaaaactgcagaggaaactgaaagttatgttccagatnactttccgttgtttaccaaattttcttagatttggtcatcatcaggaagcatttgtaaaaataaaaatctccacaaatttctgtgcccatttcaatgaaatgggcacagaaattcattctctgctttcatctctcaaagggatccaattcataactcagagctgcaattaaaaattcacgtcttccattttctgacttgttctcattctctgactgtttcagagtctccccacacatcacatgaacccaaatcacattctcaatttctgtgcccatttcattgaaatgggcacagaaattagtttttaaatttcctgattctcgatcttccttgttggtggaagctttaaactggaacgtgaacttttttgctctgtgcttactttataaaggtgctgctgtgtgaaatggagaaagttacggcgtgtaggggagtgagactcaagtttatagtctggcgccatcagctcacaggtgtaggacttgggacacggtatttatcactagatttctgtgccc

SEQ ID NO: 341475 - DNA, 2418 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacag

SEQ ID NO: 341476 - DNA, 1615 bp, Homo sapiens
agcctgcatgttttagagttttaattgaagtttaattaccaaggcatgactgaccaaatcattggtcactgttgtcaattgaactcaatctctagcccctttctcctcccacaaggttgtagttggtgatgaaaattcaaaccatggccggccctcagttaccttagcatgaactcagatacgctgaaataggcttgttatgagtaactaaagacttctatcattcaggaaatttcaaggattttaggagctccataccaggtaccaaggacaaagatcaaatatatgtattttattataccacaattatcttatatttatgaggtttctagtacttgcagactgagaacagattttttaaatgtattctggctcaatccatttaattaggctgttgaaataattttttaaagttatattacaaatgggaaaaccactcatctgtcttgcacgtttgtaaccgaatgttgcatgtgtcctatttaagtggcttctgaattaagcaactactgtgtatactatactaacaatatatactatagtaatgctttattttttaactttactattgtttttgttttatttttgtccactgtcatacagttgcatcttaatttttgtttcatttcctggtagttgtttgtggctacatcacagtttcagatagatccagtgggatacataaaattcaagatgatccacagtcttcaaaattccttcacttaaacaatttgaattccttcaaatcaactgagtgccttcttctcagtctgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatgtaagtattgtgagtcttaaaattctctgcaatagtcagttgcaagtggcaaactcatctcaaaatagcttaatcaaaaagggagactttatcagctcccataaacaacctctaaaagtcaggaatgtagacagaatctgggactcaaatagctatatgactctttccatccctccatctcttatttctgtgttgatcctgtgtttgacaatggctccttcacatgatgaggaatgtggctagttgaagttcatgagttagagccttacatttgcaattcaaaggaaaaagagccattcctccgtctccaatttaaaagctctggatgtagactcttagcatagttgaggttaaatatgcatcgtttaggttgttaagagtgagtaggatggagatagggccttactctgattggttctacacaaaggagaatttattcttcacaaaaggtgaaggtagaggggtaaaatgggaaggaactattaaaagaaggagagaaggaatactgagcagccaaaataacagacatctactgtattctgtctttggctgcccaacacatgtttatgtttttcccatacataccattctaatattgccctggcttataattataactatctcctagaatttctttctcttatcagaagatgttagaagctctg

SEQ ID NO: 341477 - DNA, 4344 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttttttttttcctccaagaggaattatttaaaaagactttagtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaactagtgtcattgatgattttttgggggggtatttttgtattctaggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactg

SEQ ID NO: 341478 - DNA, 5768 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttttttttttcctccaagaggaattatttaaaaagactttagtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaactagtgtcattgatgattttttgggggggtatttttgtattctaggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactggaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgctcgatttttatgtcctttcctcttgccttgtattgagtttaagatctctactgattaaaactcttttgctatcaa

SEQ ID NO: 341479 - DNA, 3329 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttttttttttcctccaagaggaattatttaaaaagactttagtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaactagtgtcattgatgattttttgggggggtatttttgtattctaggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatgtaagtattgtgagtcttaaaattctctgcaatagtcagttgcaagtggcaaactcatctcaaaatagcttaatcaaaaagggagactttatcagctcccataaacaacctctaaaagtcaggaatgtagacagaatctgggactcaaatagctatatgactctttccatccctccatctcttatttctgtgttgatcctgtgtttgacaatggctccttcacatgatgaggaatgtggctagttgaagttcatgagttagagccttacatttgcaattcaaaggaaaaagagccattcctccgtctccaatttaaaagctctggatgtagactcttagcatagttgaggttaaatatgcatcgtttaggttgttaagagtgagtaggatggagatagggccttactctgattggttctacacaaaggagaatttattcttcacaaaaggtgaaggtagaggggtaaaatgggaaggaactattaaaagaaggagagaaggaatactgagcagccaaaataacagacatctactgtattctgtctttggctgcccaacacatgtttatgtttttcccatacataccattctaatattgccctggcttataattataactatctcctagaatttctttctcttatcagaagatgttagaagctctg

SEQ ID NO: 341480 - DNA, 4054 bp, Homo sapiens
agcctgcatgttttagagttttaattgaagtttaattaccaaggcatgactgaccaaatcattggtcactgttgtcaattgaactcaatctctagcccctttctcctcccacaaggttgtagttggtgatgaaaattcaaaccatggccggccctcagttaccttagcatgaactcagatacgctgaaataggcttgttatgagtaactaaagacttctatcattcaggaaatttcaaggattttaggagctccataccaggtaccaaggacaaagatcaaatatatgtattttattataccacaattatcttatatttatgaggtttctagtacttgcagactgagaacagattttttaaatgtattctggctcaatccatttaattaggctgttgaaataattttttaaagttatattacaaatgggaaaaccactcatctgtcttgcacgtttgtaaccgaatgttgcatgtgtcctatttaagtggcttctgaattaagcaactactgtgtatactatactaacaatatatactatagtaatgctttattttttaactttactattgtttttgttttatttttgtccactgtcatacagttgcatcttaatttttgtttcatttcctggtagttgtttgtggctacatcacagtttcagatagatccagtgggatacataaaattcaagatgatccacagtcttcaaaattccttcacttaaacaatttgaattccttcaaatcaactgagtgccttcttctcagtctgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactggaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgctcgatttttatgtcctttcctcttgccttgtattgagtttaagatctctactgattaaaactcttttgctatcaa

SEQ ID NO: 341481 - DNA, 3593 bp, Homo sapiens
ctggaaccacagtcatgcaccatcatgcctggctagttttttatttcttcataggtatagggtttcactatgttgcctaggctggcttcgaactccttgcctcaagtgagcctctcacctcagcctcccaaagtgcttagattacaggcatgaaccaccatgctcagccatggaaaaacctcatttttaaactgagggctgcttaccactttttcccaatacttcacataatgctacctggaaattaccgatattctagtttgtatgcaaccttagctttttaaattcacatcttttaatatttttctagatatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactggaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgctcgatttttatgtcctttcctcttgccttgtattgagtttaagatctctactgattaaaactcttttgctatcaa

SEQ ID NO: 341482 - DNA, 2484 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttcc

SEQ ID NO: 341483 - DNA, 3912 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactg

SEQ ID NO: 341484 - DNA, 4078 bp, Homo sapiens
ctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttttttttttcctccaagaggaattatttaaaaagactttagtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaactagtgtcattgatgattttttgggggggtatttttgtattctaggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactg

SEQ ID NO: 341485 - DNA, 464 bp, Homo sapiens
ccgcaggtgggcagtggagaggtgaagcttctccagggaagaggaggatagcacaagtctagaaagacacccttggatgtctgggtcctcagctccagaacattcctgcttctcaaggcaggactggcccctggacctaactagcagctgcctgagcagagatctggggaggtggccaaaggggctgagtctgtgactgtaccagctggggctgaaggaaactccccaaggtgcatttccaacaaaaattcagcctttgaggctcatatgcaacaaaaattcagccttcctgtcataccgctgggcaaagcccccagtctctgcccaaacactcctgggctgtctgtggccctttacggttccttttcaccttgcagatggctctttctcatccacatcaaaatattttggtgcaaaagaaaatgctgcacggagttattcaccttaatatatagggggttcgt

SEQ ID NO: 341486 - DNA, 652 bp, Homo sapiens
aaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctca

SEQ ID NO: 341487 - DNA, 308 bp, Homo sapiens
agctagtgggttacatactgactttgaaaggctgcagtctggaagtgatggctggtacttgtgctcacagctcattggccaggactagtcatgtgacctgcctgaccacaaaggtatacggttgccaggaaatatggaagaatatgtggatattctttgagcagtgagcatctttgctttattctccttttccatttcatctccataaggttctctatgcacataaactagatgaagcttaggcctgaagcctagaacataatgacactttggttctcaaagtgtggtccccagacaagcagcattag

SEQ ID NO: 341488 - DNA, 300 bp, Homo sapiens
cccagctctgtcacctgaagcccccacgaccttggggcacactgcatctcatgggggcacaggctctgcctctataaccaggagtgtggtgaactgaataatggctccaaagatgtccacatcctaatccctggaactggtgaaaatttaccctacatggcaaaggagactttgcagatgtgattgagtcatactcttgagatagacagattatcctggattagccaggcgggccagatggatgtaatcgcagggtcttcaaaagcaaagggggagacaaaagagagaggcagaaggaga

SEQ ID NO: 341489 - DNA, 449 bp, Homo sapiens
gtcttgaatacgccttcagaggaagaagtatgacattttaagtcagacatgttgcagagatgatgataaaggcaaaatgacatgctgattacttggggagaagaataatgcacgatgaatgtatcaccatagagcaataattttacatttccttgtattgtctggcaaaggcaatatcaaacttacactgcttcctaatggcaaaagataaataaaggaaacaagaatagataagtgtgtattgaaacagaaccttttcatttccaagtaccctttttgtaagtatacacatttctaaattgctcttcagtaaaaataagctttcaggggaaaaatgaatattcagcatacctgtaatcattaatctatcattagataaataatttatctgggttactagttaagatgcttccgcttaataaacattctttcattcattcaactaatta

SEQ ID NO: 341490 - DNA, 471 bp, Homo sapiens
cctcctgagtagctgggactataggcgtgcaccaccatacctgaataatcaaaacctaacatctttaaagaacattggcataagacttggcaaaaatggcatcttgtccctcatctcatttagtccaagcgatacaggaaatgctgccacctccattttatagatgaggagtctgacgttcctagaggttcaatgccctgaaacgtcaagccttgaggaagttggagcactgggattcgaagagcaccatccaatacagacccagaatcaggatgatttgggattatgcttgtcaaggactcagggcagggctaccatacattaggcacaagaattttgatagtgataattactgtgttcattgtcacttcatcatgacagttaccgtgatgataagaaacctggcccttcttcacctgacaaaggctttcttcgtttgagccactgctcaaacgagactgaccaagaata

SEQ ID NO: 341491 - DNA, 388 bp, Homo sapiens
gcactttgccaaatgcagaggcctgaaatctccaaaaaagagccctttggactgagttcagagcccagtgcttagccctgcctgcccaggttggaaggaagggggctaggaagaatggaagttagtgtgaattagacatgaggacaagtggcccgttttgtttttaccaagttattggtacagccatcagaaagtgtcttctgggaaaaagagaatcaaaggttgaaggtttaaatactgcctaatgtttccaggggaaacaaaatgtagattgatttggaatggccgcataaatgtgctctgcactgacttaatatttatttagctaatcccctagagttggatgttgtttccagttttattcctaaaatgaatactatggtgaaca

SEQ ID NO: 341492 - DNA, 242 bp, Homo sapiens
aggcacactactgtgtctagctgtaactgaggttcagtggaattaaggactgtctcaggagtagacagctcttgatcataccgcagccagccggactgcagagactgcccagcagcactgcagagaggtttagagtggtcactggaaccagacagtctgggtttcaatctggtttctgccgtttgttagctctgtgccttgggcagcttgcctacctatctgtcctcagttttctcaattgt

SEQ ID NO: 341493 - DNA, 451 bp, Homo sapiens
ggcatggcacttgcatctgcccagcttctggtgagggtcctatgctgtgtcacagtggggtggagaaacagaagggagactggagcagagacctgcaggagagcctgggtttatttatagtaacctgctctcaggaacacatccattcccatgagagtgagaacctactcactcccactagacagctttaatctattcccgagggcagttctcccatgatccaaacacttcccactaggccccatctcccaacactaccacaccaggaatcagattccaacatgagctttgtcaggggcaaaccaggtcaaaccatagcagataccatgttatacttgcacatgagaaccctcagttacaaaggaatagcacatctgcttattaaagtagatcttttcagtcagaaaatgtgctgttcaaaattgtaagataggtgttggtccaagcatga

SEQ ID NO: 341494 - DNA, 383 bp, Homo sapiens
tctgcccaatgctgtttttaaaaatgtggatctttttgtgttctatgtgccacaggtacaattatacatatagctgactcttgaacaacacaggtttgaactgtgtggggccacttacacgcagatttttttttttccataataaaagtgacattgagtggggctgggtatggtggctcccacccgtcatcccagcactttgggaggccgaagcggacagatcatctgaggtcaggaattctgagaccaacctggccaacacggtgaaacccatctctactataaaaattagctgggtgtagtagtgggtgcctgtagtcccagctactcaggaggctgaggcaggagaatcacttgaacctgggaggcgaaggttgcagtga

SEQ ID NO: 341495 - DNA, 366 bp, Homo sapiens
atcatatgttgtaattagtaaatatgtccatatgtataaaatacatattagtgattaggggtagaaatttgatttagatatgaatatttatgtaatttgctgtataacggattaaatgagattatgatattaatgaattaatgaatatggttaaattgataaaaattcaacattttttatttaaaaaataacttagcaagtgaacctcggaaaaatgctgcttctcactttcatctgtaatcttatttcagtcctaatcaaaactctgatagctttttatgtgaaacatgaaaagcagaacttataatttatatggaaatgcgaagaatctagaaataaccaggtcaatcttgaagaacagtggca

SEQ ID NO: 341496 - DNA, 2656 bp, Homo sapiens
gcggccgcgctcacaggagcagcgtgacccgtcggccccgggggtgctggcgccaggagccagcactcgcggtgcgctcccccgcgcctggcttccctggactgtcgccagtcctactctgcctgaggtggcgagggcagggtggagcgcggccttttctggcctgaggaggagtcactcgggaggtcactcggctgctgggcgggctgctgtcacaggcgctgcgtgccctggctctgctcgccactggccggcgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcatcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttgctctttgtgggtgctatcatatatgacctggcggtggtgggcacagtggacgtgatccctctttttgtgctgagggagcctctcggttggaaccaagtgcaggtgggctatggtatggctgcagggtacaccatcttcatcaccagcttcctgggtgtcctggtcttctcccgctgctttcgggacaccaccatgatcatgattgggatggtctcctttgggtcaggagccctcctcttggcttttgtgaaagagacatacatgttctatattgctcgagccgtcatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacgaacaatgtcttttaaattaaaataaaaccttgaaaaaagtcagctttctttcctgagtcttccttacctacaaacactcaggagggggatggagctcaggcccttgtcttctgggtagttttgttactactgttgcttttaagaagcaaatgtcacaaggctttcttcaatgggatgttcaattgagtacttccagtcaacagtgcttcccaaagtgggtggtgtgaaggaagaggaggtacattaagagctattttatttgaggtagtcatttttataaccttgtttacttggatttataaaagcagactcacctaataaaatcaacattcattgtatga

SEQ ID NO: 341497 - DNA, 2382 bp, Homo sapiens
gcggccgcgctcacaggagcagcgtgacccgtcggccccgggggtgctggcgccaggagccagcactcgcggtgcgctcccccgcgcctggcttccctggactgtcgccagtcctactctgcctgaggtggcgagggcagggtggagcgcggccttttctggcctgaggaggagtcactcgggaggtcactcggctgctgggcgggctgctgtcacaggcgctgcgtgccctggctctgctcgccactggccggcgcgctcccggcgcacggagcacactcgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcatcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttgctctttgtgggtgctatcatatatgacctggcggtggtgggcacagtggacgtgatccctctttttgtgctgagggagcctctcggttggaaccaagtgcaggtgggctatggtatggctgcagggtacaccatcttcatcaccagcttcctgggtgtcctggtcttctcccgctgctttcgggacaccaccatgatcatgattgggatggtctcctttgggtcaggagccctcctcttggcttttgtgaaagagacatacatgttctatattgctcgagccgtcatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacgaacaatgtcttttaaattaaaataaaaccttgaaaaaagtc

SEQ ID NO: 341498 - DNA, 251 bp, Homo sapiens
acaagcagatgacaaaacaaagaaacggacacaacacattctaagcaattaatgacagctagttacgtatatgaaacccggcatcaagatctcattgtaaaattaaaaacagtaaaataaaatagcaaatgtgaaaccacagtaaaaaaaattgtattattttatctctttgtaagcatcggtgttgtacaaaataaaaaggaatgtgcatgaggtgagagtcatctcttgatcttaaagaaggacttcag

SEQ ID NO: 341499 - DNA, 321 bp, Homo sapiens
gttcatgatgctctctctggccaccttccagacaggaagaaagagcagaggatcactgtgagaggaatttgaggatcaaatcctgaagtggtacatgtcactactgttcatagtctctttgctggaacttggtcctatggccctactggcagagaggaaggctatgaaacccagtctaggcctgcgcctagaagaagaagaagaagaaacaccttttgaagaacagagagcagtctctgtcataccaggagtacctgtcacatacttgtagaacaaaaatcagtaacattttaattattgaaacaatgtaacaactttaaa

SEQ ID NO: 341500 - DNA, 100 bp, Homo sapiens
tgcttggatttacagtaggccactgcacccggtgtatgtttacttcttacagtcattccaattaatataataaatggctctacatactttgtgaccacag

SEQ ID NO: 341501 - DNA, 1179 bp, Homo sapiens
gctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccaaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatcagaatctgggagctcactgagctgtacgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctttcattggtttgtgaggaatgcttcatgaagttcttgttttggaaa

SEQ ID NO: 341502 - DNA, 463 bp, Homo sapiens
ctccatgatgagctttttatatgatcagaaagactgtcttgcgatactctataaaatctgatgtccatatcccacttccttgccagaaaaaaagagtcatcaataaagaagaaacataattgtagggatacctatttatctgtttattcagttcaaatgaccactggagttggtgctaaatgtgcatttttaacaagtataatatttcagcactgtcaaaattacctctacaataataggcttgttaaattatagctctataagctagggggtaagatggctctgcccagcacacattaatctatgcctgttcacacaagtgattctgctgagcaggtagcatgtttaaacaagaaatactggtcctaaaacctctgatttatggtaggtgttgttttgacacagcaccattcagacaatttacaaggcaaagcttcgtgctaaaatatttcctcagtgtcat

SEQ ID NO: 341503 - DNA, 477 bp, Homo sapiens
ttttctgcctacacagaagtccatcctcaaggcactgcaccaaaaggcctcatcaggtgaccctcaactgccttccagctccatcccctcgcacacccacaccccactcgaaacaccaagctctccccagacctttccacgtgtgctgcatggacttagatgctctcccaggctctgactgcctcacatattcttaccagtctttcacagctcctctgtggacgcttggcatgaggcggcctattcacattcctatcatagcttctgggggctccttccactagatttttctccctggggcccttttccctctgcactcctgtgcttagcacaatgcccagtgcttaaacactcagtaagcatctgttaaatgacaaggcaatccccaggttaacatcatgtcccacttcttgggctcccctccatctgtaccaccattacctttgtctgttcttcccaatcctgaaagctatttta

SEQ ID NO: 341504 - DNA, 173 bp, Homo sapiens
aatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatgg

SEQ ID NO: 341505 - DNA, 490 bp, Homo sapiens
gtaagtagattttataaagtcaataaacctagaaaatatttttgagtagcctgttagaagccctagagaaatgtgtgtcaagggcaaaaaatagcaggtccttgtactgagaacctattgttcatgagtatattctacttattttctgactcatttcttagaaactgccctctgcccataaccacaggtttaccatggaagtagcctttttcttttttctttgagatggagtctctctctgtcacccaggttggagtgagatggcacaatcttggctcactgcaacctccgtctcccaggttcaagcagttctcttgcctcagcccaagtagctgggactacaggcgaccaccaccactcccggctaatttttgcatttttattagagatggggtttcaccatgtgggccaggctagtctcaaactcctgacctcaagtgatccacctgcctcggcctcccgaagtgctgggattacaggagtgagccac

SEQ ID NO: 341506 - DNA, 222 bp, Homo sapiens
gaactgcaattacttttgcaccaacctaatagctaacatgtacaatcagttacctttaaggaaaggagatttcccttgataatgtgggtgggcctcatctaatcagttgaaggccttaagaacaaaaactgagtttcccagagaagacggaatactgccttaggacagtaacacagaaatcctgcctcagtttccagcctgctggcctgctctgtcaatttc

SEQ ID NO: 341507 - DNA, 348 bp, Homo sapiens
agagagagagacagagagagagagagagagagagggatgccctgagaccttgagcaagtcttttactgaaattcccattgcttcagttttctcatctgttaaaatctttggccatgatgtcagatccacaaataggaccgatgcctctccgccccactgcgcctgtgtcccattcccccagcaggtaccacctcattcttgggatcagggctcacctccagcacctgcgtgcattcccattcttctcgttccctttctgccacctgctctggtcctcattgtcccgtttgggcctaactccttgaatgcccagcatatggactctgccaactcctgctaatctccact

SEQ ID NO: 341508 - DNA, 383 bp, Homo sapiens
cttgtctatgtgtgggctcctttctaggcactttattttaatccactgactgatatgtttatgcttatagcaccagcacattgccctgatgaacgttcctgtaataataacccttcaaatcaggtagtataagtccccaaacttcactgtccatcaaaattgatttcgttattctagaacctctgcatttgcacatgaatttagaatcagcctttcaatttcaacaaaaaaacctattgggattttttattggaactgcactgaatctgtagaacaatttaaggaaaacaagtatcttaacaatattgagtttttaggccagtctcagtggctcaggcctgtaatcccaacactgtgggaggctgaggcaggcaggctgctgg

SEQ ID NO: 341509 - DNA, 767 bp, Homo sapiens
tgtttatcgatgccacaggaacagaaacctcatcctcacagtctgaggtttgctcctgtggctgatatttaaagttttcccctttcaactttactcagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagagagagatgataatagatggaagatgatcttgaaagatgatgcaggtgaagctggaagggtgaaatttatggctctagaacacatgcaggtggagggttagccttaggtaagtggaactacctctttgctggagcacagagatagggataggagtaaggaagaggacttggcaagggtggtgaagatttgtaattgtagaggtggatgatggggaggaagctgaccaggaacaggaatatgaagacaaaagctgctggaacagaaatactagagggctaaatatgaaccagagtccctaagttcagagccagggaggttgagatgggaggatcgcttcagcctggaaggttgaggctgcagtcagctgtgatagcactaatacactccagccttggacaacag

SEQ ID NO: 341510 - DNA, 578 bp, Homo sapiens
aaattcaattggcactgcctgcaaaaatatatccagaatcgaaccacttctcattcagtaccacgtcatgaccaccatcatctaggcaaggggaccccaacccctgggccacagacaggtctgtggcctgttaggaactgggccacacagcagcaggtgagcagcggaccagcgagcattaccgcttgagctccacctcccgtcagattagtggaggcatttgattctcacaggagctgaaacctactgtgaactgctcatgcgtggtgaagatttgtaattgtagaggtggatgatggggaggaagctgaccaggaacaggaatatgaagacaaaagctgctggaacagaaatactagagggctaaatatgaaccagagtccctaaggaatattcaggccaaaacgctggagtgagaccattaacaggagagcttatggtatatcaaagtaagaaatgagtttgaaactgggttagaagctcaggaaaatatgaagtggttttggggcattgtcactagcagtatttggttgccttgattgattgaggggtggacagctagcaagagacgagttaca

SEQ ID NO: 341511 - DNA, 269 bp, Homo sapiens
tgtttatcgatgccacaggaacagaaacctcatcctcacagtctgaggtttgctcctgtggctgatatttaaagttttcccctttcaactttactcagctatccccttacctgcactgacaggtaatcctccaccgtcctgttcacctctcaccaggttcatattttctttatcttatttattgtacttaatcgtattctggcattgtggagactagattggacgatgccagaaggactcacggacgattagatgagcctgttacatgt

SEQ ID NO: 341512 - DNA, 855 bp, Homo sapiens
tgtttatcgatgccacaggaacagaaacctcatcctcacagtctgaggtttgctcctgtggctgatatttaaagttttcccctttcaactttactcagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagagagagatgataatagatggaagatgatcttgaaagatgatgcaggtgaagctggaagggtgaaatttatggctctagaacacatgcaggtggagggttagccttaggtaagtggaactacctctttgctggagcacagagatagggataggagtaaggaagaggacttggcaagggtggtgaagatttgtaattgtagaggtggatgatggggaggaagctgaccaggaacaggaatatgaagacaaaagctgctggaacagaaatactagagggctaaatatgaaccagagtccctaaggaatattcaggccaaaacgctggagtgagaccattaacaggagagcttatggtatatcaaagtaagaaatgagtttgaaactgggttagaagctcaggaaaatatgaagtggttttggggcattgtcactagcagtatttggttgccttgattgattgaggggtggacagctagcaagagacgagttaca

SEQ ID NO: 341513 - DNA, 464 bp, Homo sapiens
tgtttatcgatgccacaggaacagaaacctcatcctcacagtctgaggtttgctcctgtggctgatatttaaagttttcccctttcaactttactcagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagaaaagaaggtggaacaatggaaagaaaagttctttggagactactatggacagaagctgggttgaccaaagaagagtcagtgcagcagtatgtaatatag

SEQ ID NO: 341514 - DNA, 742 bp, Homo sapiens
  misc_feature (696)..(696): n is a, c, g, or t
  misc_feature (703)..(703): n is a, c, g, or t
  misc_feature (730)..(730): n is a, c, g, or t
gtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagtaaggcttgtttaaaaaaaaaaagctttgggtaaaaaaaattggggnatttttnaaattttttgggggaaaaaaatttttnaaaaaggggggg

SEQ ID NO: 341515 - DNA, 2718 bp, Homo sapiens
  misc_feature (42)..(42): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacattta

SEQ ID NO: 341516 - DNA, 1622 bp, Homo sapiens
agttttaatttctgcagtggtttaagtgtattccttcaagaaataagaggaattatattacctgttttactctctgtttccccaatgctttttccatttactgggtccttattctgttatttaaacaaacaaaagcaaaatgctgtttttctcttcaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgtctacca

SEQ ID NO: 341517 - DNA, 2770 bp, Homo sapiens
  misc_feature (42)..(42): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaac

SEQ ID NO: 341518 - DNA, 2442 bp, Homo sapiens
  misc_feature (42)..(42): n is a, c, g, or t
  misc_feature (2428)..(2428): n is a, c, g, or t
  misc_feature (2442)..(2442): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaagtgtgtattgatgtgggaactgantatatcgcactctn

SEQ ID NO: 341519 - DNA, 1244 bp, Homo sapiens
cgtaatcgacggttctccttatttcagtatgggaaaattctttcaaaattatttgaaggctggacaaaaaattccacagctgtaatcctcaggatcactgtgcagtcttcaagattcagatacagaggaagcttcaattcaacctttcagagaagacattccagctcgcatgatctcatcaaccaagagaatgttggtggcaatcacagtgcaggagtgaagaagctgtttcttttcagcatgcacacagctctctgtaccttggccaggactccaccaggcaccacagtgggaggctggtagttgatgccaaccttgaagccagtggggcaccaatccacaaactggatggtacgcttggtcttgatggtggcaatggcagcatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaac

SEQ ID NO: 341520 - DNA, 2548 bp, Homo sapiens
  misc_feature (42)..(42): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacattta

SEQ ID NO: 341521 - DNA, 3210 bp, Homo sapiens
  misc_feature (42)..(42): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgtctacca

SEQ ID NO: 341522 - DNA, 2666 bp, Homo sapiens
  misc_feature (42)..(42): n is a, c, g, or t
agcggggtcacgccttccgggccccgcggctggccggctccncgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaaca

SEQ ID NO: 341523 - DNA, 1169 bp, Homo sapiens
gtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaac

SEQ ID NO: 341524 - DNA, 691 bp, Homo sapiens
  misc_feature (645)..(645): n is a, c, g, or t
  misc_feature (652)..(652): n is a, c, g, or t
  misc_feature (679)..(679): n is a, c, g, or t
gtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaaatactgcaagatgacattgagagtttaatgccaattgtatatacaccgacggttggtcttgcctgctcccagtatggacacatctttagaagacctaagtaaggcttgtttaaaaaaaaaaagctttgggtaaaaaaaattggggnatttttnaaattttttgggggaaaaaaatttttnaaaaaggggggg

SEQ ID NO: 341525 - DNA, 725 bp, Homo sapiens
agtgttcttttcttataatgtctttgtatggctctggtattagggcaatgttggccttataggatgaatgaggaagtgttccctcctctccaattttttggaaaagtttgagaaggattgatattaattcattaaaggtttagtagaattcacccatgaagccatcaggtccagagcttttctttgttgagagatttttgattaccaattcaatctccttactagttatagatctattcagattttctgtttgtgatttagtcttagtagatttgtatttctaggaatttgtccatttaatctaggttatccagtttattggtgtacagttgttcataagttcatagtactctcttataatccttctatttctgtagaattggtaataatgtccccattttcatttctggttttaatcatttgagtcttctctttttttcttagtacatctagttaaaggtttgtcaattttgttgatatttttaaagaaacaacttttggcttctctattgtttttctattctctattcatttctgctttaatttttattattttcttctgctagctttgggtttagtttgcttttctagtttcttaagttttagagttaggttattgattcaagatctggttttttttttgtttgtttgtttgtttgtttttagagggagtcttgctctgttgcccaggctggagtgcagtggtgtgatctcggctcactgca

SEQ ID NO: 341526 - DNA, 264 bp, Homo sapiens
taaaaactaggcaaactatattgtttaaagatgcttgtttaggaagtaaatcaataaagaaaagcaaagaattagctgagtgcaatggcacgtgcctatagtcccagctacttggaaggctgaggtgggagaatcacttcaggccaggaggccaaggctgcagtaagccataatcatgccactgcactccagggtgacagagcaagattctgtctctaaaaaaataataataaataagaagaagaaaaagaagtgaatatcaaa

SEQ ID NO: 341527 - DNA, 521 bp, Homo sapiens
gcccatcaatgggagaaggtctgttatgggaagactgtattgaattaaaaggttaatatcaggctgagctcagtggctcatacctgtaatcccagcactttgggaggttgatgctattactatctctactttactcaggcacagagcagctaagccatttgtccaggttcacagagctagcaggtggccatgcttacacccacagcacctgatactgtctgaaccattccctaaagtatttctacagaagagtactaataagatttttaaatcctgcaggatttttcttattattcttttcaaatattgtgtaatctaataccatgccatccttgatatctaactcattttagagataaaaatgcttaccctaaataccatcatataatctatatttctataaccccaacagcaatattgcaggttagaatccaagtgtgcagaatatttgtgaagatcagtgtagataatactgaaatgacagtgatgaggaagaaggtactagaacacagcccttcccg

SEQ ID NO: 341528 - DNA, 191 bp, Homo sapiens
ttcaacatgaaaatctgtgcagaactcttctgctaccaaactcaaacacttaataggctgttcatattaatgggtggccctcagcatcaaggatgcaatgaggaatggttgagactatagtaatttggagaggacagcgtcactgtaaaacagatagctacagctcaattagttctaacagctgccatgtg

SEQ ID NO: 341529 - DNA, 676 bp, Homo sapiens
taattactaaaacaatagtatgtgaatctttaaaaccaaatcggggttcgaggtggggtggagttgaataagaaggaatgagctggaaaatggtggtgcccagattcgaatccaggatgccaagttcccaagcctatttgcaaaagaataccaccacattgcatacaatcagctctcagaaatcacatgtgtgtccttaggaaacaaacatactatttccgcttgtcatcttttctcaaagcacatgaagacctaagatttaaatcctcagtggatcaagagttgatgagaaattaccaccacaggccacactccatacacagcacttgtttttggcctctccaaaggaaatctttccaagtaggttggaaagtcaacaagatggtaactagaagcagaactttttttattgctagaactatccaagcccatcgccactttaaattttgcctaaaaattaacaatccctgggcaaaagctctttctcatagccgaaggagcagtgataacctcacacctaaactctgcattgctctcctattgaaagacatttctggccgggcgcagtggctcatgcctataatcccagcaccttgggaggccgaggcgggcagattacctaaggtcaggggtttgagaccagcctaacatggtgaaagtccgtctctattaaaaa

SEQ ID NO: 341530 - DNA, 132 bp, Homo sapiens
ctgggctttgggcttaggtcagcagctctgtcttccagcatggcttctgtttctagtttgagcaacactgaaggaccaggggcaggggcggccccgagcccagtgccaggtcctgtgtggaatagaaaggtg

SEQ ID NO: 341531 - DNA, 375 bp, Homo sapiens
gagcagccttccctctgactcacttagctgtgaaaataggactctgccaaattactgggaactaacactgtagtaaaaccataagaaaattttgctaagaaaccttttctcatctgcaaattacttgactgaaacctgaggtgctggatttcagcacaaaggtgactttggaggggaaattttgtgccaaactggatctgttgtttttgtgttatgtaaaaaggagaaaaaaaatgaactgtttactcctaagctataaatttaagattatcctattacaccaaatgacagaatttccgaacctcaaaccttactttagagctatattttcataaactatgatctgtacccaatcaaaactagatgtaattgaat

SEQ ID NO: 341532 - DNA, 408 bp, Homo sapiens
ggcacagtgatttgcggcactggaatccctcagtcagagtctcagaatctctgctcttccaagtgagtggccccgggcaaggccgtactctccctacacctcaccttcgtcgtttgcagaaacgagaatcggagcagacacggaccgtgtcctccctcatcacatccacacacgacctggagaggggtgcactgggccagggctgggggtgagcttgggtgttcgtgactcaagttgcaaacggccctctgcccaaaatgatacaaaaccacaatgacatcagtgctgatatcagagatagtttacaggaaccctttaccctgaaaaggactactcttagattgctgaagtcaccagataagccatttcctgtcgttttaaagtaaataaaatgctactgcctggaat

SEQ ID NO: 341533 - DNA, 346 bp, Homo sapiens
ctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccct

SEQ ID NO: 341534 - DNA, 214 bp, Homo sapiens
ttctggctttcatcttccctaatatttgttctcacccttttccttagtacgtgtgtatgtgtgtgtactgtagaaaaaccctatgctactgttctgaaattgtagattctataaatgggttgggaatgaccatcttaggttgggttcctcagaagcaaaccctaaaacaagacctcaagtgtaagcagtttatttgagaggtggtggaaaaact

SEQ ID NO: 341535 - DNA, 229 bp, Homo sapiens
tttgtatttttagagagacggggtttcaccgtgttagccaggatggtctcgatctcctgacctcgtgatccgcccatctcggcctcccaaagtgctgggattacaggcgtgatccaccgcgcccggccaaaagacataagtctatttaatatttaattctgaattgttgacaaacattggtataaaacaacaggcttcacaaaggaaaggaactactacatagcttgac

SEQ ID NO: 341536 - DNA, 975 bp, Homo sapiens
agatatcactgagactgtcaaagaggctggctcagaacgttgaagcaaagagttggaacctaccatctgtttgtattataaattatgttgacagcatcttaaatgatttgggaaacatttatttggaggagtatccagtaaactactaagctgaatctatacctactaaacattaaccaaagattttcctgattgtgttatccctaccattttgtcaaaatcttcttgaggctttacaatgcattctgtatcgtagggcagaagggcattccaagaagtcgaaatttcagaaatgtatgacctgtgagtcttcctgcaaatgtggttgtaacttttagtctgggcaaattcttactagtctttgtacactagagtttctatacaaatacacatatgtgcttcttgtagggcaaggatgtctcaaggctcaacctcattttcatatcattagttattaagatcactgcagcagcttatatagtttcattgcatcaatttcccaaacagtactttaggcttgatacctacccagtacctgccaatgttacagaatagttttagttattataatagttgttcttttcatcagtaacaaaaggatatacagttcatctgtctgtactcacattttgctgaaaacaatataaaagagcctgaaaagcacatagttccttttttcttttgtaatcctagcattaatgtgtgcagctgtccatgtgaaataccaaaattaattgaacatgaaaaatatttttaaactaaagatacaaggaaacaaacacttattatatacattttttatgacagacatttacacccaacagttttatgaaggaggtcctattattacagttttatagatgaagttactgtggcccagataatttaagtaacttgcccaaagttatacggctagtatataggagaattgggatttgtacccaggtttgtttgattccagtatgcacaccagtt

SEQ ID NO: 341537 - DNA, 386 bp, Homo sapiens
tatgcttttattcttgatgtatgtagaacaagcccaatttgaattaatgaaaagtatgattaatttatttttatttttattattttttttaaccaggagtggtggcacacgcctgtaatcccaaacactttaggaggcttaggcaggaggattgcttgagcccaggagtttgagaccagccagggcaagatagtgagaccctgtctctacaaaacattttaaaattagctgggcgtggtggcgtgcacctgtagtcgcagctagttgggggctgaggtgggaggattattggagcctcgagatcaaggctgcagtgagccaagattgcgccactgcattctagcctgggcaacaaaacgagaccctgtcttaccaaaaaaaaaaaa

SEQ ID NO: 341538 - DNA, 372 bp, Homo sapiens
caggaacgctagcgcccatctctagtccttcagattgagatttcaccatctttaaattcaaaacatcggaaggagcagtcgctagtcggggcagagcagcttcccaccttcacacagccacctccacaggcacagagccccagggctcatttttcctgcagtctccattggatataacacttacacccactcagctccctagctggcctcctctcagctgtgatcgcctcttccctgaagagctctctgaatttgagtaatgacatggctgtaccattcattttgtttaaacacatttttttttttggtgaaaaattgcaaacaacctataattcaaaaattactgtaggcaaataaattatggcacatcaa

SEQ ID NO: 341539 - DNA, 447 bp, Homo sapiens
tttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagac

SEQ ID NO: 341540 - DNA, 1642 bp, Homo sapiens
ggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgatttgtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcatattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaaccaaggccttgtctgcagaaattttttattcctttttctgttagcaaccagcactcaaacgttaaatttggtagttgatgtactttgtaacaa

SEQ ID NO: 341541 - DNA, 1453 bp, Homo sapiens
ggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgatttgtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcatattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgata

SEQ ID NO: 341542 - DNA, 627 bp, Homo sapiens
caagaaagtaaatatgttatcgcccaacacctacattctaaagagtctgccgttacacattaatctctgtcgagtatctctagtatctgtttaaccaaaaagtaacagttaccattggtgaacgccccagatcaggtactaagaattctctgtttcatattttaatcatcaccaaaaaaaaaaacaccaacatgtgaggtgggcattatcatttgattttacagaagacaaaaccaaagaattaagggtgaagcaatttcccaagtacacagaattaataattcatgaaacttggaatcaaacccaggccagttctttaaggcccctgtgagctgagtctagttcagtggtgtccaatcttttggcttccctgggccacattggaagaattgtcctgggacacacgtaaagctcactaacactgaagatagctgataagcttaaaaagaaattgcaaaaaaatctcataatgttttaagaatgtttacgaatttgtgttgggctgcattcaaagctgtcctgggccacatgcccagggcacatgggccatgggttggacaagctttctagacctttctctgttgtttcttagctgaaggtagcagagcagtaacttttttttttttt

SEQ ID NO: 341543 - DNA, 357 bp, Homo sapiens
gcttgttccattatccctaaatctattatgtgctttctagaatcatattgagatatatttttatttcttctaggctttgaaatgcattagactaagtggcatgcccttaagagttttttttgttttttgtttttttttttttttttttaccatgatgagatcattagtagtttcttaaaccaagtgtaagaatacaagcaatattcaatatctaaaaccataggaactgcccaggagaaatgccttgctgtgttggcaagtctcagataactatatcttttctgcaatcggttttagatcccctgatatacctctctccaattaaatatttctacaatatgtgttagaacatattgt

SEQ ID NO: 341544 - DNA, 1024 bp, Homo sapiens
tatcctggggccacccgagttaaaggggggaaatccgggggctgctgcacccgccaccggtctgggcccagccgggggccccctgtagtcgccgcagtcccggggagaggcacctgcccccagcccggggagggggcgccgcgggctcggggagcacggacaacccctacccatgaggccctgatggaaaacacaaaggatctgagtcggaagagacattagaggtcatccaaagcagccgtcccctctgcagcctctctgacaagtgactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcaggtaatattggtgaatctgacagaggtgaaatatatgacattgattcatttagttttaattaatgacattgtaattttgaattctgtttaactagctgtttctatgtcctgtcagcacattacagctctaagcttcctaatagttgttttgatttcaataaattactctagaagagtatagttgcatgcataagttcaagtgcttttggcagtctccttaatgtttttatttggtttattatttacttttcatgtacagattctttgaattgtgaagatattaggcaaagaaatgggatgttcagc

SEQ ID NO: 341545 - DNA, 560 bp, Homo sapiens
gcacaataccagtgttctctctgacttctctgtgcaggcttctttatcatttgtataggagatagaagaaatgttcaaggcaaattttttaattaaaactttcagatggcaggagaaattatttaaactgttagatgaagattgattttattatatcatcataacaccagtgtttttattttgttaattagctacctgtgagatgtgtgggatggttggcgtccgagatgctttttactctaaaacaaagcgtttctgtagcgtttcatgttcaagaagttactcgtcaaactccaagaaggcaagcattttggccagacttcaggtaacggtacagaaactttcttacttatatccattatttctatggcttttgccatttatctgtcatttgactgtgattcactgtactccacctctgcccactcagttatggttttataccacatcttgaggaaacatgtgagccccaaagtttgttcagcctataaaattgaaaaactattttaaatggataaggcatactatccaaataaactattatttgcagaagttaatta

SEQ ID NO: 341546 - DNA, 523 bp, Homo sapiens
cctcaatgtttacttaagcagaatgtgtagtatgcagtccagttaaattgtggtggtgaggggatgaaaaagaatcctatttacttaacttttcttgttttagggtaagcctccaacaaagaaagcaaaagttcttcagaaacaacctttagttgctaagctagccgcatatgctcagtatcaagctaccttgcaaaatcaagcaaagacaaaagcaggtaatattggtgaatctgacagaggtgaaatatatgacattgattcatttagttttaattaatgacattgtaattttgaattctgtttaactagctgtttctatgtcctgtcagcacattacagctctaagcttcctaatagttgttttgatttcaataaattactctagaagagtatagttgcatgcataagttcaagtgcttttggcagtctccttaatgtttttatttggtttattatttacttttcatgtacagattctttgaattgtgaagatattaggcaaagaaatgggatgttcagc

SEQ ID NO: 341547 - DNA, 739 bp, Homo sapiens
ctggctaatttttgtatttttagcagagacaggatttcaccatgttggccagagtggtctcaaactccacacctcaggtgatctgcccacctcggcctcccagagtctcaaacttctgacctcaggtggtccgcccacctcggcctcccaaattgctgggattacaggcgtgagccactgcgtccagccaaaaccttgttactttgagcagtcagcaaagaaatagtactttatccttccccctttctcattgatcttcccagaatttttttactctgaagtaagcaattttaacactcacttcttgcctggtaagactaatgtcatagaagaaagaatcatcaggggttggatcgctctctccatctgctggcccagtggattcgatgtcttataaatctttttggaagtagttgggacatacatttatatgttaagtatttataggggtgatgataaggattaattttaaaaaggtaaaacattccttctgtaatgttttgcagacttctgagaaaagaactgtttgagatataaagaactgctttttgcgcgagtggcataaatgagtgaagtgagaattaccgtgtgtgaaaagataactgttgggtggtgggcttaatgcatgggtgatgaaataatctgtacagcaaacctcctgtaacagaccttcatatgtacccccaaacctaaaataaaagttaataaaaatcaataaatcaataaataaaagctggaa

SEQ ID NO: 341548 - DNA, 522 bp, Homo sapiens
ctttcaactacaattgaaaaacaatttttaagaaaaaagatatattaagttgaagcacctatatacaaacaaggtgataattccaaacaatcctagtttaaataaaagttctgccaatattgggatcattttttcagctaccaacagggagtctttatcgtgagtacttggaagtaataaaacactgttattattcagaatattttaaaatatagattgtgaaaactgctaaattgcttaaggtaccttagtaattaaaataaaaggtattgaaaaaaaataaaaacttaaagcctcttaaaagcagatttataatgaaggccttaattggtatcataaacctttcttttagctttagccagtttcctaaagatggagcatacttttgaacctaacagaaaacgtttatgttttatattttaaagaacataaaactgcaaaatctctgcatttattaatgccacaaacatgttcagtaaattttgttaatttaaaaaaaaaaaacctgttcaaaaatttttt

SEQ ID NO: 341549 - DNA, 423 bp, Homo sapiens
cataaatttgcaaagttaattaggactctgatcttaacgcatttccccccatttcattcctaacgctctgccgggggtgtccaagggagaggaatacagccgtgggttcttggtttctgtttctggttgagccaataaagcctcttcctcatccctcttttccgcttatcactagagacataatagaaaaactatataaaaatagaaggaatgtcttaaactccttttcccttttataattagttggcagagagacatttaaagtgtgcatatacttcaggaagacaccatataaatatgatttttatctaggtatgacatggcttcaggctgctaaaagcctaaaacaaaacaaagcaaaacaaaacaaaacagaaacaacaacaaaaacaaaataaggcgggttggacaagattgctagta

SEQ ID NO: 341550 - DNA, 953 bp, Homo sapiens
cgcttgaggctttcgagttgccgcttggggctttcgagttgctcaatgagtagttttgcataaatacacactataccactgtataatgtatgtatatttaagtaatgtatagttctattaaactgtacactcagagtgaatttgtgttaaaaaaaaaaattaaagacctaaatagaaacattccatgttcagatattgccaagatggaaacactccccgaatatacaggttaaatacaatcgttagaagactccccaagctggtttctctgtagaaacagatcctaaaatttataaacaaacccaagaactggcacagtgtctcacacctataatcctaacactttgggaggctgaggtgggaggatctgagggtgtagtgaaatcagtaggttggagtgaaatcagaagccccatacactgctagtgggaatacaatgggtgagccactctgctttaggtgtacatccaagtaaaatgacatgtctacaagcgttcatagcagtcaacaagtagaagcaactcaaatgctcaccaactgatgaataaccaaacatacccatacaatgtattcaaccatataaataaatggagtactgataatgctataacatggatgaaacttgaaaacactgtgctaagaaaacagtcacagaagtccattcgtgcaaaattatgagggacaggaaacctatagacaaagttcattcgtggttgactagagctgaagagcatgaggggtaatacctatagagtacgatttctcattgaggtgatgaaatgttctaaaattgattatggtgatggctacacaactatgcatactaaaaccactgaactgcacactatttttttttgagttttactcttgttgcccaatctggaatgcaatggtgcgatctcggctcactgcaacctccgcctcccgggttcaagcaattctcctgcctcagc

SEQ ID NO: 341551 - DNA, 667 bp, Homo sapiens
tcattattagtccacagggagacgcaatcaaacccacaatcagcacttcataccaccaggattagagtcagataatggcaagtgagggtgtagtgaaatcagtaggttggagtgaaatcagaagccccatacactgctagtgggaatacaatgggtgagccactctgctttaggtgtacatccaagtaaaatgacatgtctacaagcgttcatagcagtcaacaagtagaagcaactcaaatgctcaccaactgatgaataaccaaacatacccatacaatgtattcaaccatataaataaatggagtactgataatgctataacatggatgaaacttgaaaacactgtgctaagaaaacagtcacagaagtccattcgtgcaaaattatgagggacaggaaacctatagacaaagttcattcgtggttgactagagctgaagagcatgaggggtaatacctatagagtacgatttctcattgaggtgatgaaatgttctaaaattgattatggtgatggctacacaactatgcatactaaaaccactgaactgcacactatttttttttgagttttactcttgttgcccaatctggaatgcaatggtgcgatctcggctcactgcaacctccgcctcccgggttcaagcaattctcctgcctcagc

SEQ ID NO: 341552 - DNA, 264 bp, Homo sapiens
gacagattgattttaacaacatgtttcccgtaagtcctaactaaatggcactggaaaatctttctgttaagaaaaggaaaataaatggaccttcaacaggctctttataagcaaaggcattttcgtgccccagagaacagtcttgtaaaagggagatttataagggacttccaggaagcaagagttcagtaattttctaacactgaagcaaagcaacgggaactaggtttaccatctccaagacacaacccctattttgctaga

SEQ ID NO: 341553 - DNA, 846 bp, Homo sapiens
atacctggtgctcttcctgtgtgtctctcttcatatggcattgtcggcttcttatagggatacccagtcacattggattagggcccaccatcacgtcataacttcattttaacttgtctacatctgcaaagaccctatttccaaagaaggtcacattcataactactggaggttagaactttgacattctgggggaggcaggacacaattcaacctgtaacaatatttgtgtttaaaaaaaaaccaaaactacagttaaggttccttgaacaccctatttatgagcccatacagatccattagagacaatactatgagaatgaagaacctggattaaggagccacactgtagaggttcaaatcccagctcagccacttacaagctacataactttgaggcagttcattaacttcccagtgcctcagtttccttatctgtaaaatagcagcacataggtcaaacggttgttaggaggattaaatgagttatcaagtacttagtacaatgcctggtacacactaggtactcaatcaacatgagcaattgttgatatgattatcaccattttcagcatcccaaagactcccctaggaagcattcttggggacagagcatgctttatttttatagcacctactgaaggcctatttccatagctgcttccccaatagtctcatgcttgactttcagagcatcagcaatttcatctgatgcagagttatactgctgcagtaaatattcttcatccatgccattattcaattcccttccttggtgcagacccctctgtgacatggcagtgatgctcatgaaggccggcggagtctccaagcagcaccacctag

SEQ ID NO: 341554 - DNA, 113 bp, Homo sapiens
acatgttcaggagagccccaggacacatttaataggtattcaggttcttttccactctacctagtctaagcttgcatctcagtcaactagaaacactgtagatcttagtttca

SEQ ID NO: 341555 - DNA, 253 bp, Homo sapiens
ggacgaggagaggaggggaaggaagaagaggtggggagaggaggagagaaagcaggggagaaaaagttactgcacgagtggggaaaactactgagatgtgtaaggttgtatgaaaatacatctgttccacaagtgtctcagtaaaatcaacatcaacaaaccacaaggcttaaaaaagtcacctaatcagtatatatgaaatggagacatcatttttacctatacactaatgcgggatcacccctcagcatct

SEQ ID NO: 341556 - DNA, 1014 bp, Homo sapiens
tacagacggggtttcaccttgttggtcaggtttgcctcaaatttctgacctcgtgatccacccaccttggcctcccaaagtgctgggattagaggtgtgagccaccactctcggcctgtatgtcttcttttgagaaatgtttatttagtcctttgcatactttttaatgggattattcctttattttttctgtttagttgtaacaaagtctttaataacaatttctaataggaagaaaactcactctggttaaccacactccatggtattgcagcatttaactatagaaactcaaaagaaacaaaacgtgatccttaactcaaaaggaataaaaaacttcaactaaattatcatagctccatacatgtatagctaacttcctgcctcctctgtcttctctttactcgaattaaccacattctttcatcatactcatattcctattagtttttcatatttctgatttgtaaaatgggctgttcaaagtgatttattgttcttaactttccatagaaaaacagtcaaaataaatatattatcagtatagatttgttttagaaattgaattttatggcatttgcatttttaatgtcagtgaatatataagttgactcattgatggtcttctatgtgttagcacttggcttataacacatctgattatacatgctgtcttattagcttaaaacttaattaaattgtatatgaaaattaaagttcaatcaagcatttcagagacccaaaattttctctgaagaaacctaggattgatcagaacataattgtggaagtccctaaagtacatcatctctaaggagcttcccatatgtaatattttctgatttttaagttatcacaacacacacacacaaaacaaacaaacaaacaaacaaaaaaacccttgttgaaggaataagggacagagttatgaaaaacactgaaaaaaatttaacaagttttaagaatttagagttagaccttatagggccaccaccctctctaaaaaaactttat

SEQ ID NO: 341557 - DNA, 318 bp, Homo sapiens
catatctaaattttactttacattatgttatcatcatgggtgtctctaagagaaagtctttgtgcagaaaagtgtggttttgtgagtgatgggccaaacatttcttcattaatctcaaactggcacagctgaaagatttcagggttagaccatactgacctaagcttggttttaagaatacagtacttctgtttggtgtttgtcctgctgtatatcaatagatcttcaatggaaaaccttttgttacatagagtcattaactaccatggtcatgtgtatagaatgatctttctcctcacctagggaagaagtctttta

SEQ ID NO: 341558 - DNA, 216 bp, Homo sapiens
agaaatagtaggaacagggtaatgccaccttaaccaagtgatcaaacttaatctcaccaacaatgggacaaaattgtcatttatcttctgatgtgattccatgaggatccatcacctatttagtgttatcaccaacaatatttagcctaaactgatcactaggactgatctgacaaattcaaattggggtcattctgcaaaataactggcctggag

SEQ ID NO: 341559 - DNA, 329 bp, Homo sapiens
tttgaatatttgcatatgtgtaatgaaatgtcttggggatgggacccaagtctaaatatgaaattgatttatgtttcatatataccttatgtacatagcttgaaggtaattttataaaatatttgaaataattttgtgcatgaaacaaagtttgtgtcaggtatttatatgtggaattttccacttgtggcatcacattggcactcaaaaagtttcagattggagcatttcagatttcagattttcagattaggattgctcaacctgtattatcttgctcaaagtccttttgtgacttctaattgccccaaaatccttaacatggttca

SEQ ID NO: 341560 - DNA, 85 bp, Homo sapiens
agagaagcagattgtggaataaaagagaggatgttccatgttcatatacacctgattgtagttagagcctcacccttcctttcta

SEQ ID NO: 341561 - DNA, 818 bp, Homo sapiens
cgctgcagttggcaggctgctgcgggaggcggcggcggtaggaagccggagacagcagggtgacaggtaggcggcggtgctgtctttgggggaggcaaagtgctagatgaagaggggttttcttctccttcggccgcggaaactacagacgggagctggcgagggtggtctggaaaggcggtagccgaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgaggtaggagacctcaagaaaaataatttctacatagtgaaatgaaatatgtataccaaaacacataaatttaagttttataattttctttccttgtggatctggaaaattttctttctgctgtttttcattctgatagttgctttggctttccctattccctgcctttccatattttgaaatgttttggtcaaattttttcctgttgagtgtgcagtatgttttgattgttaattttattgaccatcatctcagtggattatttatttgaaacttttctgtttcctgttctggaatgtttcctgctctggaagccatattttaactgtatactgatccagctttatttatct

SEQ ID NO: 341562 - DNA, 714 bp, Homo sapiens
cgctgcagttggcaggctgctgcgggaggcggcggcggtaggaagccggagacagcagggtgacaggtaggcggcggtgctgtctttgggggaggcaaagtgctagatgaagaggggttttcttctccttcggccgcggaaactacagacgggagctggcgagggtggtctggaaaggcggtagccggtgtgttggtggtcccggaacctctcgtaaaccagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcaggtaatcctctcctaaccagcagcttaacttaaagtgcatcttcatttttgtcctaccactaaaagcttgcttattgacctccttctttcctgtctcctaaattgtgactggctctcagttagacttgcatctgttgctatttgtagcagcaattg

SEQ ID NO: 341563 - DNA, 864 bp, Homo sapiens
aaattcttctcaaatataaatgtagtacattggctaaaggactaataatctagtaaatttagtagtacagtatactgaaaggtacattgatgtatgggcacaaaatacttcttatagttagtggattggtcagtttaatatgtggtctctttacacaaaggttttggttaaattaaaatgtggagaaattaatattaagacttttaaaaatattatacagatataggtgccttaaaaaaaaaaaaacaacagttacaaccaaaagaattgaaatgaccagtgcactttattttccttttagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgca

SEQ ID NO: 341564 - DNA, 184 bp, Homo sapiens
ctgcctctgcctcctgaatagctggcactacaggtgcgtaccactgcactgggctagtttttgtatttttaatagggatggggtttcactatgtcgcacaagttagcctcgaactcctgagttcaagtggtccacccgccttgccctccaaaagtgctaggattacaggcatgagccaccacat

SEQ ID NO: 341565 - DNA, 120 bp, Homo sapiens
caagcgtgagccactgtgacctgcctttgtttcatattttcttccgtgtttttttcttccccccctcctgttgcccaggctggagtgcagtggcgtgatctcggctcactgcagcctcgc

SEQ ID NO: 341566 - DNA, 322 bp, Homo sapiens
ttgaaatgaccagtgcactttattttccttttagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggtaagttgaagatgacagtttgggaaattttaagtattttttaaggtcctctgaaataatacttaaggaatgtttagagaaaaataaattggccaggcgcagtggctc

SEQ ID NO: 341567 - DNA, 910 bp, Homo sapiens
cgctgcagttggcaggctgctgcgggaggcggcggcggtaggaagccggagacagcagggtgacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgca

SEQ ID NO: 341568 - DNA, 1063 bp, Homo sapiens
cgctgcagttggcaggctgctgcgggaggcggcggcggtaggaagccggagacagcagggtgacaggctggagtgcagtggcgtgatctcggctcactgcagcctcgcctcctgggctcaagtgattctcctgcctctgcctcctgaatagctggcactacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgca

SEQ ID NO: 341569 - DNA, 173 bp, Homo sapiens
taaaaccgtgtaatgctgaccatagaataggcgtgtgtatggatcaatgcaaaaaaattcagactctaaatataaactcttacatttttggtcacctgattttcaacaagggtgccaagaccattaaaaggaaaaaaaaaaaacaccaaaaaacaaactaacaaaaaaccccc

SEQ ID NO: 341570 - DNA, 122 bp, Homo sapiens
ttcagttattttaatagcagtacttttagagcccttgtacattttttatgtgtgcgaaaattatataatttctaagctgaatttggctgctatagttttacatatcagatgggggagaatga

SEQ ID NO: 341571 - DNA, 114 bp, Homo sapiens
cgtgaaccaccgtgcccagcctgagaaggctttatttctaaactccccacttaatgtaacactttacttctttctttttattgatatagataatatttgtgcatgttttagggg

SEQ ID NO: 341572 - DNA, 936 bp, Homo sapiens
ggaggacacaagactgaggctggagggccagtttggaggcaggtgcaagagtcacagtgagagacagtcagggcctgaactcagacagtgtcagcaaggatggaaaggaggagtcggaggcgagagaggctgaagccaacaggggtgggcagttgaatggaagtgaaagggatggacaggccaatgaggactctcaaatctttagcctagagaatggatagtggtaattccttcaaccaactcagggatcacaggaagggaagaggtggaagagaaatcctgttcccatgctgagctgatgattctgtgggacaccaaatggagatttgtagtagtagactgttggagttagaggtctgaaactcaggggagatattgcttgggaatccccatttatctaaaactatgtactgaatgcctcctgtataccaggcaccgtgatgagtgaagaatagagaatgatgaacaagacagacaagatactgccctcaaggaccttaggttttatgtaggggagactgaccacaaataagtaaacaagcagacaacagaacagcagactgcaatatgtgctatgaaggaataaataaccggtgtctatcatgacaaataaccaggggagcaaggtggccttagagcgggtcagggaagagatgaaggaagaccattcttggcagagcaaacagcaagtgcagatgccaaggcaggaaagcacttgaagttccaggcaatgaggaggtcagtatgagtgagtatgagtgcagcagggcacaagaggtagcccgggcctagaagccctggtgaggagcaatggacagtcaccgaaggctttcagtagcagcaagacatcagatgggaggagggggtgaaagtaaggagagggcaacattcacacgtttaaaggacaagagaagaggaccccgggaaggagcagct

SEQ ID NO: 341573 - DNA, 723 bp, Homo sapiens
ggaggacacaagactgaggctggagggccagtttggaggcaggtgcaagagtcacagtgagagacagtcagggcctgaactcagacagtgtcagcaaggatggaaaggaggagtcggaggcgagagaggctgaagccaacaggggtgggcagttgaatggaagtgaaagggatggacaggccaatgaggactctcaaatctttagcctagagaatggatagtggtaattccttcaaccaactcagggatcacaggaagggaagaggtggaagagaaatcctgttcccatgctgagctgatgattctgtgggacaccaaatggagatttgtagtagtagactgttggagttagaggtctgaaactcaggggagatattgcttgggaatccccatttatctaaaactatgtactgaatgcctcctgtataccaggcaccgtgatgagtgaagaatagagaatgatgaacaagacagacaagatactgccctcaaggaccttaggttttatgtaggggagactgaccacaaataagtaaacaagcagacaacagaacagcagactgcaatatgtgctatgaaggaataaataaccggtgtctatcatgacaaataaccaggggagcaaggtggccttagagcgggttgaaggaattaccactatccattctctaggctaaagatttgagagtcctcattggcctgtccatccctttcacttccatt

SEQ ID NO: 341574 - DNA, 433 bp, Homo sapiens
cctagaggctgaatgggaagtatgagaggacaatagaagttacgatgacatccaggatttatggctaaagcaactggaaaggatggtgcggtcatgagctgagatggagaagatgataagcagagcagactgggggtaggtggaaatctgggtagcagtgttggacatgttaacttcgagatgccgtcagacctttacgtggggattccggtctggggttccaggcaatgaggaggtcagtatgagtgagtatgagtgcagcagggcacaagaggtagcccgggcctagaagccctggtgaggagcaatggacagtcaccgaaggctttcagtagcagcaagacatcagatgggaggagggggtgaaagtaaggagagggcaacattcacacgtttaaaggacaagagaagaggaccccgggaaggagcagct

SEQ ID NO: 341575 - DNA, 2139 bp, Homo sapiens
ccgcgcatctgttacttgtagcagtgactatatttaaatcggggaggatggtgtggagggggcggggaggagaggagaatttttccaaaatctgacggaaagaaaagaaacaaatggttcagatgggacggagggtgggggagggggggagggtgagtaggaaccaggagggctgcctggggtgggggaataaattaaaaaaaggaacgagttaacaacagcaccaggaaagttacttcagtcaaaagacgcttttgaaaagaatatttctccgtacaaaatgagaaattaaacgaacgtaaagtcccccaaaccaaagtttgtgatgtgggatggttggctcggatcccgaggtgggtgggcctatgaggtggttgctaagtcgacgcaagggcggcgggggtggtctcagggatggacaaggggatggagtagagtatgtacagcccccggggctcacaggggagggggacggcggaggccaccgcgaattcgccgtccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattcctccttcaacttgtcagtggaaaggaaagtcccttggtggaatggtaggaatagttttaagcggggtatcacacagtgccttacagtggagaatatcaaagcgttttcagctcttcaatcttcgtatgcatgacatgggtgaacacaagactaataaacaacttgatttccttaggagattctcagtgctctatctgttttttaagtaagaagattgagtttcatgtatattgagtgactaaagtgtaagcttagaaatattt

SEQ ID NO: 341576 - DNA, 400 bp, Homo sapiens
ggaatcattaaagagggaaattgttgctttatggcacggcgagagaagagttaggtagttagtgggagtgtagcatccagaaagaggaaaagatccgctgtgttctctgtgggatgaataatacggcagctagtccaatgtctactgcaacttcaagtagtggaaggagtacagggaagtctataagctttgcaacagaattacagagtatgatctcgtattgttgctgttgagaagtcctggctgggaacggtggctaacacctgtaatcccagcactctgggaggctgaggaaggaggattgcttgggcccaggagtttgagaccagcctgagcaacatagcgagaaccctgtctctactaaaaatgaaaaaataaaaatagctggtgtggtagtact

SEQ ID NO: 341577 - DNA, 1742 bp, Homo sapiens
ccgcgcatctgttacttgtagcagtgactatatttaaatcggggaggatggtgtggagggggcggggaggagaggagaatttttccaaaatctgacggaaagaaaagaaacaaatggttcagatgggacggagggtgggggagggggggagggtgagtaggaaccaggagggctgcctggggtgggggaataaattaaaaaaaggaacgagttaacaacagcaccaggaaagttacttcagtcaaaagacgcttttgaaaagaatatttctccgtacaaaatgagaaattaaacgaacgtaaagtcccccaaaccaaagtttgtgatgtgggatggttggctcggatcccgaggtgggtgggcctatgaggtggttgctaagtcgacgcaagggcggcgggggtggtctcagggatggacaaggggatggagtagagtatgtacagcccccggggctcacaggggagggggacggcggaggccaccgcgaattcgccgtccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctga

SEQ ID NO: 341578 - DNA, 1934 bp, Homo sapiens
ccgcgcatctgttacttgtagcagtgactatatttaaatcggggaggatggtgtggagggggcggggaggagaggagaatttttccaaaatctgacggaaagaaaagaaacaaatggttcagatgggacggagggtgggggagggggggagggtgagtaggaaccaggagggctgcctggggtgggggaataaattaaaaaaaggaacgagttaacaacagcaccaggaaagttacttcagtcaaaagacgcttttgaaaagaatatttctccgtacaaaatgagaaattaaacgaacgtaaagtcccccaaaccaaagtttgtgatgtgggatggttggctcggatcccgaggtgggtgggcctatgaggtggttgctaagtcgacgcaagggcggcgggggtggtctcagggatggacaaggggatggagtagagtatgtacagcccccggggctcacaggggagggggacggcggaggccaccgcgaattcgccgtccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaagggtcttactctgtcacccaggctgaagtacactggcatgatcacagctcctgggctcaagcaatcctcccacctcagcctcctgagtagttgggactacaaagcacatgccaccatgcccagcattttttttttctttttatagagacagggtctcactatgttgctcaggcttatctcaaactcctggattcaaactgtcctcctgcctcagcctcccaaagtactgcgattataggcatga

SEQ ID NO: 341579 - DNA, 1528 bp, Homo sapiens
cccagcctcgctgccgccttgcagtttgatctcagactgctgtgctagcaatcagggagactccgtgggcgtaggaccctcagagccaggtgtgagatataatctcatggttcgccgctttttaagccggtgtgaaaagcgcaatattccgggtgggagtgacccgattttccaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattcctccttcaacttgtcagtggaaaggaaagtcccttggtggaatggtaggaatagttttaagcggggtatcacacagtgccttacagtggagaatatcaaagcgttttcagctcttcaatcttcgtatgcatgacatgggtgaacacaagactaataaacaacttgatttccttaggagattctcagtgctctatctgttttttaagtaagaagattgagtttcatgtatattgagtgactaaagtgtaagcttagaaatattt

SEQ ID NO: 341580 - DNA, 593 bp, Homo sapiens
gtattctttaggtgatgctagaaggcctcttcatgaaacagcagttttggtagaagatgtggtacacactcagttaattaatctggtaagagcatatataatttgatttggtttctcttctctgcattcttttattaggatggtaacccaacactttaaaaacattttatttacagctggaattcttttttgttagcattattgaagtatactttatatataacaaaatttactagtttaatgcataatttgctgagcctcaacaatggaatattataatattaacttataacacaatcatgatatcgaaaatttgcataatctaaaacaaacccttgttcccctgggcagtcagcagccatcatcatcacagcagaaagattatgactcactgaaggctgagatggttgttagcattttgtaacaataaagtatttttaaattaaggtatgtacattattttttagacatgccatttgacaatcaatagactatagtatagtgtaaacatagcttttatatgcactgagtaacctcataatttgactgtacacctactctgtacccacaaaaattaaaagttaaaaaattta

SEQ ID NO: 341581 - DNA, 1184 bp, Homo sapiens
tgccaggggcattatggctgcctctgttgccccacgcaggtcgccagggaagtgggggaaagccagcagccgcaggcctcacccagctcccatgcagcccacagcccgaaaggccggtctcactccaccatgccctctgcccgtaacagcaccaactttatttccaggcagctggtgagcagggctgagaactttccccaggctaccggcttcctagctgagaaagcaagcctactcacagttcctctgcgtcccacagagcctgcagtggtgatccacctccttcaagggccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaatttctttttctttgacagaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattcctccttcaacttgtcagtggaaaggaaagtcccttggtggaatggtaggaatagttttaagcggggtatcacacagtgccttacagtggagaatatcaaagcgttttcagctcttcaatcttcgtatgcatgacatgggtgaacacaagactaataaacaacttgatttccttaggagattctcagtgctctatctgttttttaagtaagaagattgagtttcatgtatattgagtgactaaagtgtaagcttagaaatattt

SEQ ID NO: 341582 - DNA, 2690 bp, Homo sapiens
ccgcgcatctgttacttgtagcagtgactatatttaaatcggggaggatggtgtggagggggcggggaggagaggagaatttttccaaaatctgacggaaagaaaagaaacaaatggttcagatgggacggagggtgggggagggggggagggtgagtaggaaccaggagggctgcctggggtgggggaataaattaaaaaaaggaacgagttaacaacagcaccaggaaagttacttcagtcaaaagacgcttttgaaaagaatatttctccgtacaaaatgagaaattaaacgaacgtaaagtcccccaaaccaaagtttgtgatgtgggatggttggctcggatcccgaggtgggtgggcctatgaggtggttgctaagtcgacgcaagggcggcgggggtggtctcagggatggacaaggggatggagtagagtatgtacagcccccggggctcacaggggagggggacggcggaggccaccgcgaattcgccgtccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtattttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaagttatttctttaattctgtgggagttttgtataattttacttttatggtttttacacatacttgaaacactctttctaaa

SEQ ID NO: 341583 - DNA, 2193 bp, Homo sapiens
ccgcgcatctgttacttgtagcagtgactatatttaaatcggggaggatggtgtggagggggcggggaggagaggagaatttttccaaaatctgacggaaagaaaagaaacaaatggttcagatgggacggagggtgggggagggggggagggtgagtaggaaccaggagggctgcctggggtgggggaataaattaaaaaaaggaacgagttaacaacagcaccaggaaagttacttcagtcaaaagacgcttttgaaaagaatatttctccgtacaaaatgagaaattaaacgaacgtaaagtcccccaaaccaaagtttgtgatgtgggatggttggctcggatcccgaggtgggtgggcctatgaggtggttgctaagtcgacgcaagggcggcgggggtggtctcagggatggacaaggggatggagtagagtatgtacagcccccggggctcacaggggagggggacggcggaggccaccgcgaattcgccgtccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatataccatgctggtgctcaaaaacttttggattttggagcattctggatgttcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattcctccttcaacttgtcagtggaaaggaaagtcccttggtggaatggtaggaatagttttaagcggggtatcacacagtgccttacagtggagaatatcaaagcgttttcagctcttcaatcttcgtatgcatgacatgggtgaacacaagactaataaacaacttgatttccttaggagattctcagtgctctatctgttttttaagtaagaagattgagtttcatgtatattgagtgactaaagtgtaagcttagaaatattt

SEQ ID NO: 341584 - DNA, 434 bp, Homo sapiens
ctcaggccttttgccactcttcacgtaatatgatttctagtttactcaccagtctggttattctactccaaatggcatccagctgtctaggtcggtgtgacagctgatgcaaccatagtgtggtgtctgaatgtgacccatccaaaatgggaacgagcttgcagccccattctagatcctgtgttctctcaatgaagtataatgttgatttagcatttgggagagccattttacattatatatttatactgaatttatgtttgattcaaactcctaagtttgtgttagttttaaattactgcaattactgagacaccttactcataggcctttggagtcatgatttccagaaagaattaagaagataataatctaggactagtctctgaataatttttcattgactaagtcttaggtaacaatttctgagtgct

SEQ ID NO: 341585 - DNA, 301 bp, Homo sapiens
tttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagaagcaggaagcaggcagaagcaggaagcaggcagaagcaggaagcagtgaagcggcagaagcaggaagcgggtaccgagctc

SEQ ID NO: 341586 - DNA, 328 bp, Homo sapiens
tttgaaatgttattctatccttttcccttcactgccaagagtacttgcatctcctattctcctcttaatacattacaatgtggcttctgccctgatcactcattcttctgaaagtcccacaaagagagtatcaacaaactttctttgttgcctcaaatgccttgtctgaagaattggagtctactggctcaagacttattcaatacttaattcactacctccatgctcccaccattattctcttagttctacctcacctactaattcgtttcagttatgattttagaacattcttttctgcctcaccctgaaaagttaggcacctcag

SEQ ID NO: 341587 - DNA, 560 bp, Homo sapiens
ctcctcattttccccagccacacaggacaggtgtccccaccctctcacctgcactcagaaggtgggctttggactcggaggccctgcctttcccagcccatagcctgccaaatgataatgcactggtttcccagaaaaagaaaataaaaagagaaagaagcagtctgggggccaccgggagatcagaaaagagaactaagtctctctgtggcagggcagtgcttagcagaagggaactgtttttaggaagctcagatcctgatgcactggctcagagagacaatgtgggacatttgaggtcagtggctcatcctttctgcgccccagtttccaattctgcggaacaggcactaatcatacgacaccatgtgtcgtggaaatggatgaataatcagggcctcccacagaggacgaatgccccaaaatgcaaagtcaggagtggcagtgaatactgatcactgggaagtggaggagatgcgttcagacaccaagctgcaaccttggctgtgcacatgcgcttaaagctctccttgaaggatgcatttctgacaaaagaaaga

SEQ ID NO: 341588 - DNA, 758 bp, Homo sapiens
ccactgcgcccggccttattttcttacagttctggaggctacacgtccgagatcagtgtgttagcatggttagtttctggtgaggggtctctttctaggttacagatgactgccttctcactgtgtcctcacatggtggagagagaaagtgcaagttctctggtatctcttcttataagagcactaattctgccatgacgaccctcatgacctcatctaactcgaatgacctctcaaagaccccatctccaaacgtcatcacattgaggcttcaacatgtgaatttggggtgagcaggacacatttcattccatggcaaaatggatcatacatctaaatgtaaaccacaaaactgtgaaacttctagatgataatataggaaaaaaagaggtgaccttggtttgacaatgagtttttaggtacaacaccaaaggcacaatccatggaagaaacaattgacaagctggacttcattaaaatgaaaaacttctgctctgtaaaagacggcatcaactttgggaggccgaggcaggcagatcacccgaggtcaggagttcgagaccagcctggccaacatggtgaaaccccatctctactaaaaatacaaaaaccagctgggtgtgtggtggcacctgtaattccagctactccagaggctgaggcaggagaatcgcctgaacccgggaggcagaggttgcagtgagccgagactgagccactgcactccagcctgggtgacagagtgagactccatctcc

SEQ ID NO: 341589 - DNA, 657 bp, Homo sapiens
gaattggagagattgatcaaaaggtacaaagtttcagttaggagcaagttcaagagctccattgtacagcatggtgactacagttcataacagtgtatagtattcttgaaagatgcccaaagagtagattttaaatgttctcacttcaaatgaatatgtcaggtaatgcacatgaattagtgtgatttagccattccacaatgtatacatgtttcagaacatcatgttgtataccatatatatatacagtttttgtcaatttaaacagtaaatacaaattttgtatttataaatatacacttatatttataaaacaagaggaagcattttatgagattacttatgttatttcaccatttaatagaaacttcaggctggacatggtggctcacacttgtaatcctagcacttttggaggtagggtggcagggagcagattgcatcgcatgaggccagcctggggaacatgcagaaactctgtctctacttaaaattagcggggcgtggtggcgtgtgcctactgtagtcctagctctctgggaagctgaggtgggaggatcacttgaacccaggaagtcgaggatgcagcgagccgtgaccatgatcatgtcactgcactgcagcctgggtgagagagtgagaccctatatcaaaaaa

SEQ ID NO: 341590 - DNA, 748 bp, Homo sapiens
tcctgggtagctgggattacaggcacccgccaccacattcagctactttttgcatttttagtagagatgaggtttcaccatgttggccaggctagtctcgaactcctgacctcaggtgatccaccctcctgggactcccaaagtgctgggattacaggcatgagccaccacacccagcctattctacattttttaaagattaattctaaaatcattttgccaagtaaaagaaaatctcatcagaatttttattggaattggattcacttaaaggttattttaagtgggaagaatcgatgcttcaggttttgaattttgtcatcctagaagaggaagcatatttttccaaagcagtaagattgaaactaagtcagtttttttgtagcacatttaggatctgtgaggcaaaaatcggtagaaatattagaatgtaagtattaaccagcaccagaggaagaaaagactgcattgtggaacaaaaaaaggagaatagatttcagagaattataaaattgtagcgattgatctgtgtaggcattctcctaacagctctccagctaagactgggccaccttgcaaagcagcatgttcccttggtaaatggctcttatttttaagaatgtctttatatagagccagagtgcataccagtgtgattttgccattgccttccaactccagaaagaaaactaactttgccttctctagtacatgagcaccctggagatactaaaactcttattctgac

SEQ ID NO: 341591 - DNA, 825 bp, Homo sapiens
ccttcatctttattcttcttttaaaaaatttctggactattctacattatcatcatcatcatcattattattattattattattattatttgagatggagtcttgctctgtcggccagtctggagtgcagtgacacgatctcagctcactgcagcctctgcctcctgggttcaagtgatttgcccacctcaggtgatccaccctcctgggactcccaaagtgctgggattacaggcatgagccaccacacccagcctattctacattttttaaagattaattctaaaatcattttgccaagtaaaagaaaatctcatcagaatttttattggaattggattcacttaaaggttattttaagtgggaagaatcgatgcttcaggttttgaattttgtcatcctagaagaggaagcatatttttccaaagcagtaagattgaaactaagtcagtttttttgtagcacatttaggatctgtgaggcaaaaatcggtagaaatattagaatgtaagtattaaccagcaccagaggaagaaaagactgcattgtggaacaaaaaaaggagaatagatttcagagaattataaaattgtagcgattgatctgtgtaggcattctcctaacagctctccagctaagactgggccaccttgcaaagcagcatgttcccttggtaaatggctcttatttttaagaatgtctttatatagagccagagtgcataccagtgtgattttgccattgccttccaactccagaaagaaaactaactttgccttctctagtacatgagcaccctggagatactaaaactcttattctgac

SEQ ID NO: 341592 - DNA, 460 bp, Homo sapiens
ccttcatctttattcttcttttaaaaaatttctggactattctacattatcatcatcatcatcattattattattattattattattatttgagatggagtcttgctctgtcggccagtctggagtgcagtgacacgatctcagctcactgcagcctctgcctcctgggttcaagtgatttgcccacctcaggtgatccaccctcctagcacttttggaggtagggtggcagggagcagattgcatcgcatgaggccagcctggggaacatgcagaaactctgtctctacttaaaattagcggggcgtggtggcgtgtgcctactgtagtcctagctctctgggaagctgaggtgggaggatcacttgaacccaggaagtcgaggatgcagcgagccgtgaccatgatcatgtcactgcactgcagcctgggtgagagagtgagaccctatatcaaaaaa

SEQ ID NO: 341593 - DNA, 403 bp, Homo sapiens
tcctgggtagctgggattacaggcacccgccaccacattcagctactttttgcatttttagtagagatgaggtttcaccatgttggccaggctagtctcgaactcctgacctcaggtgatccaccctcctgggactcccaaagtgctgggattacaggcatgagccaccacacccagcctattctacattttttaaagattaattctaaaatcattttgccaagtaaaagaaaatctcatcagaatttttattggaattggattcacttaaaggttattttaagtgggaagaatcgatgcttcaggttttgaattttgtcatcctagaagaggaagcatattctgaactagtcagttttttgtagcacgaagtaagtacgcaccagaggaagaaagatgcatt

SEQ ID NO: 341594 - DNA, 235 bp, Homo sapiens
ttcgtgtgtgggctagtggaggaagacagaggagcagtgggggaaactggccaggagtgaatctgtaggagaagataatgagcaaaggaatgctggtcattctctcaggttggtgttatggaggggctgttgaaaggtgaggaggagtgaaagcaaggaactaaggaaaggaacggataacctactggcctcacctactcatagtcttggttgcatatgatacgacgtgactcag

SEQ ID NO: 341595 - DNA, 196 bp, Homo sapiens
ataatgtaaatatagatagcattggatttgacccataagccataaagattctagaataccagtgttcccaactatggagtgcccaatgagcttcttgacaaactcaggagagtaacctccatttgtgtgacctcctttctttgctctttatttgtgcttttcaaagggatgacatgagcccataaactactcattg

SEQ ID NO: 341596 - DNA, 530 bp, Homo sapiens
tggggagtggggaatggagtatgaagtgaaaggaggagtttggtttgtagagtttgagatgccagagggccatccaagtggaaagataatcaccagacaataggaaatgcaaagttgaagcttgagccaggctggagtcattgattcaggagctgtctatgagttgaagctatacaagtggattaataaaaggataacctcaagaagcaaatgattttagggcttcttttttcgttgaatttagaaaagaatcaagttaacaggaaaaggtggttcacatctgaaatttggtatttaactgcattttagacccactaagtctactccatgctgtctggattcacattcgctttcctattcttggattccataacataatcccatcttgtactttttagatactgatttccccacataggtacatttttgcaattgttttcctctaatgagttgtaagacagataaaatgtgaaaaattggcattaaacatcacttgggaagagtttgtttctttttagcttgaggttggt

SEQ ID NO: 341597 - DNA, 590 bp, Homo sapiens
tggggagtggggaatggagtatgaagtgaaaggaggagtttggtttgtagagtttgagatgccagagggccatccaagtggaaagataatcaccagacaataggaaatgcaaagttgaagcttgagccaggctggagtcattgattcaggagctgtctatgagttgaagctatacaagtggattaataaaaggataacctcaagaagcaaatgattttagggcttcttttttcgttgaatttagaaaagaatcaagttaacaggaaaaggtggttcacatctgaaatttggtatttaactgcattttagacccactaaaaaagctaaaaatagttgatgaagtttggagaagttatgctgaaggttatttgggtccccgtctactccatgctgtctggattcacattcgctttcctattcttggattccataacataatcccatcttgtactttttagatactgatttccccacataggtacatttttgcaattgttttcctctaatgagttgtaagacagataaaatgtgaaaaattggcattaaacatcacttgggaagagtttgtttctttttagcttgaggttggt

SEQ ID NO: 341598 - DNA, 370 bp, Homo sapiens
agcaagtttgaatttcatttctacacacagagttaattcaaacaagccagttacagctgggtgtggtgtcgcacacctatggtcctgcctcagcctcccgagtatctggtattacaggtgcatgccaccacacctggccaacatagcaggtcctcatctctaaaaatatataggaaggaattctttttgtaatatttagtttcttttcctgtggaatatcaaatgcagagttgttctgagccagcattggctgttcgtctgtcctatttttcccttagtacttacattatcgagtttccatgtagttgctcatcttggtggtgaaatgaagagcccgtggttgtccctaagatgtaaatgagtccagcct

SEQ ID NO: 341599 - DNA, 211 bp, Homo sapiens
tcccccgaggtcagggttaaccaacaactctcactaaatcctcaccagtcatccctccacattgtctaaaaaatgaaatcttttgattagattttcacctctctgctctggttagtttatgataaaagtactcttctttggggaatgcccaagagactgtgagaagcaaatgtgagagagctgaagactggatcaagtctttgcagtacat

SEQ ID NO: 341600 - DNA, 443 bp, Homo sapiens
acaacgcgcagcaggactaccacgcccgcagctacttccagagtcacgtggttccgccccttttgcggaaaactgatcaggatcatggcggtacaggaagggatggctggatagtagactacatccacatcttcgggcaaggacaaagatacctcaacaggagaaattgggcagggacagggcattctctccagcaggtgactgggcatgaccactacaatgctgatctgaaaccgatcgatgggttcaatggaaggtttggctaccgcaggaacactccagccctccgtcagagcacgtccgtcttcggagaggtcacccacttccctctgttctaacagcatcttttcccttcatagccatcgacctgaatttctaagacaaatgtttagatgaactcttagtgttattttacgttaaaaaaattaatttgtgtctccaaa

SEQ ID NO: 341601 - DNA, 445 bp, Homo sapiens
aatgaatgttgggcggttctggaggcctcagggaatagttcctcccagggagggtgagaggcatggccgtacaaatgaatgtggccagaaagacatctatctgccttttaaaatgggctttggagacttccagggacctgggtcatccaattctgttggttgtgtttaacatgaacggtaaaagttggaaagcattcacatttggacatgctgtcttgaccatcttcggaatggttcttttacaagcgccattcagaggtagcggggcttggtcctctcagataagccttttgcctctgtcttgtgacaccgtgtttgagagggtattgttggagttagttggaaaagtgttgtcattttttggtgtaatacctcgatacttttaagatgaggtcttgggcctgtggtttaaaaatgatacatggaaaaaaatgatacttgattg

SEQ ID NO: 341602 - DNA, 732 bp, Homo sapiens
gttaattccacctgcaaccttaattccctttgccatgtaatgtaacattcacaggttccagggattaggtcatggacatcatttggggacctacccagcttattccacctaccactgatagttagggggcaagtaaactttactcaaaagtctgtaagtgagggaggtagggaatagtattctagacggagggaacagtgtgtctggggtgttcaaggaagaataaggggatggtgactgaaatggagtaagtgagggggagaatagtggaaaatgaggtcagagaggagaggtaatgggggcagatgtattacatggccctgtaggttattgtcacaattggtctttacccagaaaaggtggaagacaataaggatgagactgttgctgggttcaactagtttgggagtaaaagttagcttagaagcaaggagacaagttaggaggctacttgtagcaatctaggtgagagatgatagtgatagaaaaagtaggcaggcaagaagggaaataatacaataacagggaaagatggaacataagaaacaatagcaagacagtagattttaaactaagcaaatcaggcatgtgcctgtagttccagctactcggaaggctgaggcaggaggattgcttgagcccaggaattcgaggttgcaagggagctgattttgtcactgcactccagcttgggtgacagaacaagaccctatctcaagaaaaaagtaaata

SEQ ID NO: 341603 - DNA, 142 bp, Homo sapiens
atcaccccaacctccttcaggctcatcctctggcctgaacttcctgtgcttcttacttagttgtcctcatgatacattttctcaaagcacagcccgatcacccttaacactgccatgtgtacctagaattaagtttaaaaag

SEQ ID NO: 341604 - DNA, 773 bp, Homo sapiens
tggggataagaaattattttattgatttgtcttattcatagttcttactagaggacctgacatttagtagaaactcaattaatacagtgagtgaactgaatgtggtccctgcccttgaggaagatcaaatttagtgtagtcatatgtcacttaactacggaacatgttctaagacatgagtcattgggcgatgtttttttatgaacatcgtaaagggtacttatgtaaacctagatggtatagcctactacatacctgggctgtacctactacatacctggtctgtccaacagaggactacatacatagtcctttgttgaccaaactgttggtatatggtgtttggaagatatggtgggacaaggcaggaagcagaaatatgcaactcttaagacataatatactaagtacttagaaatgagaccatgtatgggaaaactgaggagagagtaattaattttggctcaaggaaatatttatacaggaagtagtagttggtagaccttacaaaatgagtaagaatttgagaggcctttttggggaagaacattccagactatggtaaatggccagaatagtctcacaggaagagtgcaactttgtggtctttggcagagatacatggttcagtattgttggggacttggattataaggaagagttataaaagtaagaacaggctgagtgtggtggctcatgcctgtaatcccaacacttagagagcccgaagcgggtggatcacctgagataaagagttcgagactagcctgacc

SEQ ID NO: 341605 - DNA, 633 bp, Homo sapiens
agtttagttctactttaattgtgtgtatgaaccaaatattgatgtgctgtatcatttggtatgtgaattgaatgaatatttatgcagatataattattcatcatgaagatatctctttttgaaaatgttaaaatgtgtgttgaccatctataaattatagatgaatacattttcagttagaaaatcttggtatgtcacgtgtcttttaaagaataaaatctgtaacttctacaattgaagaaaaagtttaaatcattgtagaattaatacaatggatagtttttacttttacatttattttagaaatgtctttcatttgaattttctgattaataacaaaattaagcttctacaatgtatagaagatacaaataactgactgtctcactagagaaagaatgcactcctttaggtaggtcagcagtcttaaaagcttgctcttaaattcctgtttttctgcattagtgtgtttataccacagagtcacttttatattataacataagcctaaaataatacattgtgtttgttttacagtcctcatgatatgaatgaagttgggtatggtctaaatatttccagactatctttttatgctttttgtcattgaagaaagagcattgtacaagaagc

SEQ ID NO: 341606 - DNA, 350 bp, Homo sapiens
cctccttgttttcatgttagccatccctctgaccctactctccaaaatgagcctcagccaggctgctgcttttccacatcactaataagattccttttatggtcttgtgaaaagcgaggggctccagacagatcctccggcaggagggtggaaccacctgcaggccccttccccctaaactccaaacacacgttcaagggcagtttgagtattcacagtcagcttgggccagccagatttaaacgcagccagactctttagcttaaagttctccctaataggggattaacaaacaagataaatactcttggtaaaaatgaaatcccacaacagaaacagcccttggacct

SEQ ID NO: 341607 - DNA, 438 bp, Homo sapiens
tcaataattagccacagagccaagactagaactcagggatttgggaaagccagtgcagaacaggccttaagaatggcattatgagggtcacaacacaaatcatgaagttctttatttatctgaaagtctagtagctccctgtaatcttaaaccaaagtgaatgaaacaatttgattgttgtgttatagtataatccaatggaagtattcaaaatttattcaaattcctagaacttaaaagtctgaagagaaaatgggcatcgtttttgtttgggaaaagaggattcagaagactcacagtggaacattcagcgctttcttttacaatagcagagaaaaggagaaaaatattcagagttaacataatccagccacttagtgttttctgcctgaatactcacagaacagagcttataatttcacccagtctcaggcaaaa

SEQ ID NO: 341608 - DNA, 414 bp, Homo sapiens
ctgcagtgcacagatagactggaccagcgctgggtgacggtgctcaatctttctgctgcaatggaatggagtgcactgacgctctgcacaaatatctgcacagggcagtgttatagataaccactcactgctccctgaggggcttgagatcattcgatgtctaagaactactactggcttgtaaatgtcaagagaaattatgaacatttgtagaaaagtaactgtttgactaatttcctgttccatggagcaaacacactgccccatgtatttagaatctggtgctgacagccaggccatggcaagcttcaaggttataggatcataaatgggattagataagccagacagtgcggctcagactccagcactttaaaaatattattaaaaccccaggaaaggcaaacaattttg

SEQ ID NO: 341609 - DNA, 316 bp, Homo sapiens
cctgcagaaccacatgtgagccaatcaaacctcttttctttataaactacccagtctcagtttttgttttttttttttttttttttttttttttttgagacagagtcttgctctgttgcccaggctggagtgcagtggtgtgatcttggctcactgcaagctctgccagttatttctttacagcaatgagagaatggactaatatagcccccatatgaactatcttcctccttctgaaagaaggcttggccatcttttggttttctttcttccttactttttcaacattctctctcttcctttgtggcagctgagg

SEQ ID NO: 341610 - DNA, 818 bp, Homo sapiens
gggaaatgtggtgttctgttctgtgagtgactcatgtaaacgagtaaaagaaactagagtacattgttaaaattacaaggtaaactaattcctactttgctagttagtgtgtcctataattctcatttaaattgcacagattactaaacaactacagaaattttcacccaaagcagttcatagacaaaatttcacagaatttttcagtgtgattttatattgttaaaattcttgtagacttatgaaatatactttcatttggttctcaggataataggctgtatatagtttcttaggcattttgggttccagagcctgtggtactttcctatataattgtcctttttatattcttatattcccgttgatatattgaaagagtttcctgaagttatctgttcctatataattgtcctctttatagtcttatattcccgttgatatatcgaaagagtttcctgaagttatctattgctaatatttagcatttacttttaggagcaaaattctcaggagaattgagaaatctgttgtcatttattttgattatgtccaagtaaaggtcagagatatgaaattaaatgtttgtaactgacaaactagtcatcacagtctacttcaaagggaatgtctgtcacagtttcagtagtgccagggtacatagagatatgttgtatgaaaaccatatggtcttgggaagactgtagaggaatccttttgggaaaagagtatggaatggacaggaacagttcagggaataaatgggattatatccagcgaggttgaagaataggaaaaacagaaacatccagttagaa

SEQ ID NO: 341611 - DNA, 213 bp, Homo sapiens
catcagaggaacataaatacagaacaagtgtagaaaaggaagcaattttcacaggagaatcacttgaacccaggaggcagaggctgcagtgagcagagatagcaccactgcactccagcctgggtgacagagtgagactctgtctcaaaaaaaaaaaaaaatgtagctgggtgtggtggcacacacctgtagttccagctactccagaggctg

SEQ ID NO: 341612 - DNA, 425 bp, Homo sapiens
aactgggatgaccaggacatttgggcgtgaaaggggccctacaagccttaacagatactaaagaacgtcagacaagcagaatgaggatggccccaggcaaggtggaccccaccccagctgcagggaacagcaaggctgcaggtacctgctcatttccagctcccagcctccctcagaacacagactgccttgccattttcttagcgagcggtttgcagcaaagtgctattttgctctcgaacgccttcctttccaattgggacaaacggctatgaatacggcacaccctgttttgcattcaaactgttgggaaagttttgcggctgtaaatatcatgctcttggtgctcaagacagaattattattactttttccttagttcttggaaccagtgataaattaaacatttcttttgcccccccttg

SEQ ID NO: 341613 - DNA, 244 bp, Homo sapiens
tttatcgttgccattaaactaaatatatactgattattttcatcaggcaccagcgttaatgtgtttctcctaagtgagttgacctcatgggaattcatcacatctgtggactatattttagtgttaaaggcttaatgtactactgtttcaaaacttacaagtattggtatttcacatgcttttaaaagtactgttgtactttttttttttttttaagacaaggtctctctgtcacccagactgg

SEQ ID NO: 341614 - DNA, 173 bp, Homo sapiens
gctaccctaatattttctaaatgtttggaaaaagaaaactactactagaagtattcctttaaaacatgtctaccagttatctatcttccctaccaacttccttcctctaatcccaagagcataccacgtcagtcttacaagttgtttcccctcacatctcactacctatgcct

SEQ ID NO: 341615 - DNA, 353 bp, Homo sapiens
gaaaaggaggaaagacaggttagctggggatgatgacggatctgaagcaaagccattcagtgaggctgaatgatggacccttcatgccagtgctgggatttggcacttatgctcctgatcatactcccaaaagccaggctgccgaggccaccaaagtggctattgacgtaggcttccgccatattgattcagcatacttatacctcaagagagaggaaatattctacaccatcaagctttgggctactttctttcgggcagaattggttcacccggccctagaaaggtcactgaagaaacttggaccggactatgtagatctcttcattattcatgtaccatttgctatgaag

SEQ ID NO: 341616 - DNA, 504 bp, Homo sapiens
tccagtatctccctccatgggttcagccctccttctcctgagttgtcaaaaggacagtgaaataaatatgacattttaggttctccaatcccaaagcctatcccaaatcttatactcagtggagagagccctgatccaatcagtccaatagtgctgttgcttcttgcatctaccagtgttgcctcctggccctccagagtttggtgatgaagctagtctgttctgtaagggacctccatgacccatgtctctggggagtaagttgtggctgttgaagggaggtgatactatcaccttttcttagaccattttgtgttgctataatagaatacctgagactgggtaatttataaagaacaaagacttacaggtttggagcctaggaagtccaaggtcaaggggcctgcatctggtagaggccttctttctgtgttatcccctggcagaaggcagaagggcaagagagaggaggggggccaaactcatccctttatcagaatccca

SEQ ID NO: 341617 - DNA, 216 bp, Homo sapiens
aggacttaaatttttggagagacaaatgtcaccttttgtttactttctgtttcttggatttctggctatatgtgctgtattttgaaatctttatgtcttcagcacacgtcagccagtaaattgcattagtttacataggtagttacataggcaacctccgcctcccaggttcaagtgattctcctgcctcagcttccctagtagctgggactacag

SEQ ID NO: 341618 - DNA, 1287 bp, Homo sapiens
  misc_feature (3)..(4): n is a, c, g, or t
  misc_feature (7)..(8): n is a, c, g, or t
ggnncgnngtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcattaaaaggctcaattaaccaactgaaggggcggcctctgtacccatttcgacctatcgtgagtcgtattccatttaactggacgtcactttacaaacgtcatgactgataaaa

SEQ ID NO: 341619 - DNA, 1650 bp, Homo sapiens
ccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgctggcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggcccttgttagatcagaatacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcatta

SEQ ID NO: 341620 - DNA, 1364 bp, Homo sapiens
ccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgctggcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggcccttgttagatcagaatacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctctcctaagttcctcatcaaatctgatggctatgttcacagagttagttgacaaaaatccagagtcctcaattactggacttgcgaaatccttcaaggtgactgtcaaggtcaagaagaattttcaggcttttctttgccatggcccatgaactccagtccttcaataggaatctctttctcctttattgctttctgaacacactg

SEQ ID NO: 341621 - DNA, 1177 bp, Homo sapiens
  misc_feature (3)..(4): n is a, c, g, or t
  misc_feature (7)..(8): n is a, c, g, or t
ggnncgnngtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcatta

SEQ ID NO: 341622 - DNA, 1910 bp, Homo sapiens
ccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgctggcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggcccttgttagatcagaatacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcaggtgagccctcccgcctctgttcccaggccctgcattctcggcgctgtgtcccaccacactcatcgtattttacggggattgggactggactggaagggtggagaaaagtcgcagtgaggccagtggcaggagctcgctcccctaccatcaccaccgaggccacttgggtgtctctccgaatgacaaatattggggcagtgcttttcaagaagcacagtcacatcctttggttcatttggtgttcaccctaaactcgcaagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcatta

SEQ ID NO: 341623 - DNA, 823 bp, Homo sapiens
ccacatttgcaggacttgatctcagtgagagattgaggaaagccaaggaaaacaccttcctgggataatatttgacctttatgtccgaactgtaggctgaatcatctgcttcaatgggttctagcagagaaagtgagtttatggtttatccatctcagtcggccaagagagtcccagtttatacctgctgcctttgtgtcattaacactacccccttttacttgtgcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgagagtgtatgt

SEQ ID NO: 341624 - DNA, 923 bp, Homo sapiens
  misc_feature (818)..(820): n is a, c, g, or t
  misc_feature (828)..(828): n is a, c, g, or t
  misc_feature (834)..(834): n is a, c, g, or t
  misc_feature (839)..(839): n is a, c, g, or t
  misc_feature (849)..(849): n is a, c, g, or t
  misc_feature (851)..(851): n is a, c, g, or t
  misc_feature (853)..(853): n is a, c, g, or t
  misc_feature (855)..(855): n is a, c, g, or t
  misc_feature (878)..(878): n is a, c, g, or t
  misc_feature (885)..(885): n is a, c, g, or t
aaatgtgaagcatgtgacaaagttttcagtcgcaaatcacaccttaaaagacataggataattcatactgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgcagtgagtatagcaaaccatcaagcattaattgacattggagtcaattcagcattgacttgagtttgtgttgacttaacattgagttcaagccttaattgacattcaagtgtttatgttaagaggatggggccaggtgttggtggctcgggcctgtaatcccagcacgttggaagaccaaggcacataggtcacttgaggtcagaagtttgaaaccaccatgggcaacagatgtcggcactttcgccatcctgttttttggtcttattttcttatttatttatttatctatttgagatggagtgtcactcttgttgccagctggagtgcatgatgtgatctcagtcacacaaactccggctccgggtcaagcgattctctgctcagctccctgtnnnggttcggntttgcnccccngtatttgttngngncngggtcccttggggtgggcccccngttgccngggtccgtggtaggggacgcggggtaaagggagaggcg

SEQ ID NO: 341625 - DNA, 277 bp, Homo sapiens
agtaacactacaacaattgcaaatcattggagaatccatgatgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacat

SEQ ID NO: 341626 - DNA, 648 bp, Homo sapiens
cctgaaaaggcacatattatgatctaggtccagggacatttaaggcaaatttacacttactgtcactgtggagtatctctataaatagatgtttataggtggaccagtccttagaattcttccgtacaaacacccaggggtgttccacttccagaatttattttctcactcattactctactttgttttaaactttcatttctcagcatatgcaagaacagcacttgtcacacaaaggagctgatataattaaaccggatgatgggccccacaagtaaagccagccattcatgaaagctggtcaccagaggccatttcaaacaatgcatattttaaagtcatctaaagtaatcccttctctcttctgacttggtttccatgaagtctcaagcacatgtgtgctgcaaaaaggaggtttattaaaacctgatgtgatattagagattacagtgcaacagggttgggctgattttaatatctcagtcttcaaaaagaaaagcaatctttaataatatttgcaagcttactaaaacatcctgcatagaaaggaagatagatgatgtttattaattaaggaaaaaccaaaataaagactgcactcatgttctcttgatagggtatatataaatttgcataataaattgaggg

SEQ ID NO: 341627 - DNA, 384 bp, Homo sapiens
catctggtggaagaattggggttgtttccacattttggctattgtgaatagtactgctatgaacatttatgtacaaatgtccatttgagtctctgctttcaagtcttttgagtacatacctaggagtggaattactagatcatgtgggaattgtttttgagaaactgccaagtggagaccttcatttaaaaaaatctagagccagggtgtggtggctcacacctataatcccagcactttgagaggctgaggtgggaggatcacttgaagccaggagttcgagaccagcctgggcaacatagtgagactctgtctgtacaaaaacatgaaaatattagctgggtgtggtagcgcttacctgtagtcccagctgtttgggaggct

SEQ ID NO: 341628 - DNA, 368 bp, Homo sapiens
gtatacatcgttatgagtgtgtattgccaccattttcccaggggttaaaagacaggtagactattgcctattaacccagggttctccgaaccgattggtcattattgtcattactgcttttctcatttgtcattattacatcatttctttctgtgctcattgtaatctataatgacgaaatagcagatcttttgcttgttaacagtgttttgtgtctttgttaggagatttcataccatgttaatcattatggaaacactacttaagagaatatggctgaaatatgtttgggtttttaaaaatatctttcttacagactaatattgtctgtggacctttctacatttgtttgtttgtttttgaaacag

SEQ ID NO: 341629 - DNA, 487 bp, Homo sapiens
tggtttagaaaatttcatttgcttctcgtgaagtacaagactgaagattcatattgcacataaaaaattaattcttggtccattattattttcaacctgtgttaataatgtattagatgagtttattgcatagatgtgaatgtatagatgggcacattttgggttagactggtcagatgtgattctgagatcactcttattccaaaccaaatttaatgctattggtttaatgttttaagaaatatgactctcagttcataagaggggtttattcaaagtgtatgttgttttagtaaaggctatatttctgatattgattaagccatcttccactggtgtacgaatgattaattcactattaaatcttaggacatgagcaagccacaggaccaacattttaaaaactaccaaagtacaagtacaactgtataaaaaggacataaaagcctaatatacagctttcctaatattatgtctattttaacag

SEQ ID NO: 341630 - DNA, 770 bp, Homo sapiens
accaaattgggaggagggagatcctcaaggatgggaaacattcaagcagaggattaaagcatcaggagcattctgctgggactgagaagcggagggcactgcattcatatctgtgcaaaaactcagacaagtccttttggctcctggcaaccctggtagggtagactgacgcctagagttcagaatgcatagaataatagagagagatgggggacaagcctggaagggtgaacaaaggaggttagattttaacctggcctcaactttagaacctgagggaaaggattctgaatgagaattaaagacccatgagtgccctcagtcataccttgcaaatactggtgactcaccacagtttttctgcctatgaagaccttgactataatgaggataacttttatcttcattgatttggttaaaatggaacaattagagtcaagaaatttgtgaaaggtttaatttaatctaaatctctggagaagaccactggcaaaatcaatggtactttattaattcattaaaattcagatatttataacaatttaaaatcatgtttgcactggctaggttaaaaaagattcttgatcctaactagtaaatgccagctttgaccctgctgggaagaaaaaaaaaatagttccattaaaagaatgagaagacaatttcaaatttactataaagctacagtaatcaagacagtgcagtattggcatatggaaacacatgtagaaacagaattgaggccaggcacggtggctcacgcctgtaat

SEQ ID NO: 341631 - DNA, 751 bp, Homo sapiens
cggtcggggtcagagtgcgcggaggtgagtcggctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacga

SEQ ID NO: 341632 - DNA, 1761 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341633 - DNA, 1685 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341634 - DNA, 1915 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattggacccagaagactgatgaggctgccaggtatggcagatctgctcagctgttctcagtagccaacccctccctggctgggttcccttcacttggctgtaggtgatctggctataacctggcacttctagttgtggcatcccagaccaggagaaagacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341635 - DNA, 1661 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaagacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341636 - DNA, 1407 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccggggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341637 - DNA, 1206 bp, Homo sapiens
tagcagttatcccgaagtttgagtttagagtttgaggtgtagtatccttcatggggatttgatccttggtattgaaatagacttgttgcagagatgtgtatttatccacagcatcattggggctttccagctctcacagaaccttcagcatccccagctgccggtcttggcatcttcgaagtaaggagaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341638 - DNA, 1056 bp, Homo sapiens
  misc_feature (24)..(24): n is a, c, g, or t
  misc_feature (40)..(40): n is a, c, g, or t
aacttagctaggtcgaggctgggngtgaatcggccgaggngaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341639 - DNA, 1335 bp, Homo sapiens
gaaattggctgagagaaaaggtcagggtcaggaataacagtttcattatctgagcaactggacatagaggctggcacttgggcacattgtcacaaatctttgtgttgggattaatgccactaacctgtagtgttggggttccatctctgatcattatcagctaaaaatcttcaaaatgtttgtcatgcttcaggtgccctggctgcagagttgtgccaacttggtgcagattggggcacctctcccactactgggctgtttgggccagtattttgaggttctgggaagtatggaagtactggctgggcaatatgggaaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341640 - DNA, 846 bp, Homo sapiens
gggactgaggcagcatggctcaggagctacttatcttattctcaacccagaaacttcactgtccccaaggcccctctgactcagcggtgaagccaagaaatctgagagcaagaaagagaaaactccacctgaaaatactcgggaccataatacttgggatcaaactgagctggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341641 - DNA, 701 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctcctgaggatgaatctgtggcttgtcgcc

SEQ ID NO: 341642 - DNA, 460 bp, Homo sapiens
gcttacagcttcgccatgggctgctggcccaagaatggacttctagacatgaacaagggcctcagcctgcaacacataggccggccccacagcggcattggtcagtcccttcgcatattcccccggcagctccatccatcgtcccttgcccgcgtgccccagtccccaggcacatagagagtttccatggctcattcagtgccccaacagggctctctacataggtggggggatggtggaaggggggtggcatgagaaaattactgaatgggaccactggaaggcaccactcaaagtggtattttggaggaggctggggtctgggctttgggtgagtcacagatggccttggactcaggccaaggtcctccttcactggctgcatctctagtgggcaatgtcctcagtgggtggggacatgtcagcttacccaccccccatggagctggaggaggctgtt

SEQ ID NO: 341643 - DNA, 836 bp, Homo sapiens
  misc_feature (2)..(2): n is a, c, g, or t
  misc_feature (25)..(25): n is a, c, g, or t
  misc_feature (28)..(28): n is a, c, g, or t
  misc_feature (60)..(60): n is a, c, g, or t
  misc_feature (97)..(97): n is a, c, g, or t
gntgaaaaaagggttccgaaggaantgnaatggccaaaggaaaggccttttttagatccnaaacgtcaaagtcaaattttttgtcaaccttgtgaanaattgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacga

SEQ ID NO: 341644 - DNA, 1733 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacga

SEQ ID NO: 341645 - DNA, 1927 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgggtctgcactggcctgcctggatagtgcctggggagagggtgctggctccttccttcctgagctgacccccttggagccccagagacatctgaggaattggttcttgccagacaccagactgttcttcagtagcaaccatagatggaagaatggctagatggatggacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341646 - DNA, 1845 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaagggcagcagtcctggaacagcctcaggaacctcatgctaccagtcagaggaagctcagagaaaggagaacacaccgggggtcaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341647 - DNA, 1899 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgggtctgcactggcctgcctggatagtgcctggggagagggtgctggctccttccttcctgagctgacccccttggagccccagagacatctgaggaattggttcttgccagacaccagactgttcttcagtagcaaccatagatggaagaatggctagatggatggacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacga

SEQ ID NO: 341648 - DNA, 1059 bp, Homo sapiens
ggacgcgtgggtcgacccacgcgtcgggtcagagtgcgcggaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341649 - DNA, 931 bp, Homo sapiens
cggtcggggtcagagtgcgcggaggtgagtcgctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccatct

SEQ ID NO: 341650 - DNA, 1027 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcagaaatcagtcggaggattcccacattccggttaaaatgacttacaaaactgggccgagaacacaatgggaggcatcagagggtctaaccttgtagaacagttgatatagtcccaggccttgagagtaccacagtccgactaagttaaaagcaccagatttcgatggtaccataagtgttagaacaggaggataaattacagaggcgatggggtgggaatggtaagccaaaggctggaaagcaaagtagttgggaagaagggtacgatgaattgggaatggcgaagagaaagggagtagtaaaatcaagaaaaagagagagagaagttatggttaaatgagaaagactaggtaggtaaag

SEQ ID NO: 341651 - DNA, 548 bp, Homo sapiens
cggtcggggtcagagtgcgcggaggtgagtcgtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccggggtgggtgatgctgaatggccccgccaagattgggccctggttaatgcatgcggggtgagggtcgcggtgcgcagaatttatgcaacctggggtgctggcccatgtgcttaccctggatgcttacttaatctactgagtaatgttctggcggaggggg

SEQ ID NO: 341652 - DNA, 1091 bp, Homo sapiens
cttattgtagtatagcagtattaaattggtgctttgcagataaagaattttttctgaaatgggtattataatgttgttaaacgtatataataaaaaatatatcttcacattctagtatatctggttttgaagaatgaatatgtaaattgcgcagaaatgggtatgaaaagactttctcattaacatttggattgtgaatgctcgagtttataaatgaaaatatttactctatataaagaagttttgtcttttggaatttgtaataagttcatttaatatactcttgctccagggatttcagtatttgtcttgaagaaataataaaatctcacctgtcaacttttcttattgtagcttttgtgaagtatagaaggctaaagcaaattggttaaattagacattgaaaaaagtatatgattattatctccaaaatattgagactttacacataacagcttttgggggctagatttagaaaatcactaacataaaacaattagaatgttcttaattatagttttcagaactgactatgtagaaaaaaatacactcaagtttgtgttctatgtttacatgttgttttgacaaaaatgaatgttatgtttgaatttagttttgggagatttcagtttttttgtattcagaaaagtcttgtttgtctggttgtatttcccccaattttcataacttttatttaactgggttagttgtcatacaaaattcagctaatgctccactaggggtagggttgcatatacatagagcacagatatggcttctactccaaagagctcatgatctaagatatagcttgaagagtacttaactatgaaacatttaaattactgagctgacaaaataaaatgaatgatctgtaataagattaataaagctttttgacaaaaataattttttacctagattttgaagaagtggtgtgtataggttggtggaaagggaaggagataacagctagggggaagagcatgttaaaaaagcacagatattttgggatgctgaggcaggtggagcacctgaggtcaggagtttgagaccagcctcgccaacatggtgaaacccagtctttacta

SEQ ID NO: 341653 - DNA, 701 bp, Homo sapiens
gacacacctgttactcagcctcaggacatcctgatgacacgtgcccaaggtggtcgggcatagcttggttttatacattttagggagacatgagacatcaatcaatataagaagtacattgattcggtctggaaaggtggggcagcttgaagcaaaggcaggaagcctccaagcagggagggaacttccaggtcgcagataggtgagagacaaacggttgcattcttttgagtttctgattagtctttccaatggaggcaatcagatatgcatctatcttaatgagcagagggataactttgaatagaatgggaagcaggtttgccctaagcagttcccagcttgagttttccttagtgattttgggggcccaagatattttcctttcacaggtgtgacccgacactcctggcctacatccttgactgaaagaagtgctgcatcacggaacaaacgctaaggtgattattaggtctctcaccctctccttttctcattcttactctttctctctcactttcactctagctttccctctctctgcctctctcccattccctccactggacccttgaacttagggataagctgttaatagtcccctactattgtacctgtatttctctacaagttgcctagctagatctttgggaaaagtcccttcggttttttttgtttttgttttttttttgagacagagt

SEQ ID NO: 341654 - DNA, 133 bp, Homo sapiens
tggatctcgcaggattgatgcattttatctaatttgttgaaattatgagtacagagttgttgttagaccatttttaaaagttaccattgtgggccaggtggggtagttcatgactgaaattctagcactttgg

SEQ ID NO: 341655 - DNA, 334 bp, Homo sapiens
ggttttattgtcagtttttacttaataattttaagaagtaatgcatgcctgtccacatccattcctatatggcctagaacaattaattggctctaagtcttttgactcttaaagccctcagccatagggagtcctgcggaggaaaaaataacactgcagaattatatgacttctcctgtgacaaaagcttttctctcccaaatactagtatatggtgcaatacaaaagtgatgggaaaaatagatttgtctactgttaacaagtctataacaatttaaacaccaaggaccaggcactttttgcatttaatttataccctcctcaggatactata

SEQ ID NO: 341656 - DNA, 1026 bp, Homo sapiens
aacattttcctgtttcagtggccttaatagttgagtaatgctgttccccttaggtgaggggtagtcagcacagtataaaaaaattttacaggtgccgtgtgagagctgttccttctggttcttggcactgttcctcttcctctagactgctaggaaggaataagctgaaaatttcaattgtgtaattttttagtgtttttgtccctgaagcctgtgaaactttaggctctaaaaacattttgttaggtgactatcgtagacaaaattacttttaaaaatgctgagtatgggtgtcgttggaaattgatttccagtccagtaaatggtcttgctgtgggatagaatcattttctcaggccatgtaacttgaaaaatagtactggattcacactacgtacgaataatgagatacagactaacggtggatggttatgcggaaataaatactaaggaaaacattagttttccatatcgtgttcattctggagcattgagtaatagtttggtgcagttgagaatttttttccctcagtttgccaaacattaaattatctttgcaaggacaccctgttgagaaaggaacctttttgaaacttacccctagtccaaatttttaagttgttagtaggtacacttagttcacctatcctaaagctgaacatgttctatgcttgaatgtaatcatttctttcccctctcttaagggactcaactgtaaaacagagaagatgagctctatttccgtaaagtggttataagagtacagttaaacacttgtggtgtacgactgctagtatatttaaaaatcaaaactcatttgtcttctatttcgaaaccatcagtgatttcccattgcctttggaatagtctgactaaattcaagggctcttttaaaagatcaagtcataacctgcctttttagctaaatctgccactctcctagtgtactctgtctggtataccaaactctgcagtatttgttctggcaaatttttatgccctgtgttctttgacactcctgacttt

SEQ ID NO: 341657 - DNA, 897 bp, Homo sapiens
agcccgcggcccgccaataccaatgtccctataaaattacctcttgttaagaatcactgctttggagttcccatcatggcgcagcagttagtgaacccaactagcatccatgaggatgcaggttcgatccctggccttgctcagtgggttaaggatctggtgttgccgtgagctgtggtgtaggtcacagatgcagcttggatgctgcattgtgtggctctggcataaggcggggccgtacaaggccccgtggtgatgcctcaaaacaccacttaggtttgggttcgtttagttcgagtttggggttttcatttgaacttgtttgatgtctgcagtttctgccatgacctgggtagaacctatgggattacccgtctcctggaataactgtttgacgttttccaaagttgtagagttagtatggcctctgtttaaagtggctggggccaaaataagggatgagttattatctcctactaaccttttagttttgtaaatcactaagaaaattgtttgcttggaagatataagttgaattggaaactcattactatctatttctgaactgctaagaaccctttcagttttcttacagctgagacacttttaaacagcgggcaaatgttatcaaatgaatatttgattgtgttttttctcttcacttccccttaaccactttagaaattccagagatttttttcccctcagaatattagttttggaagattgtgcccagctatatattttttagcagttctaatggtgcccatttatcctgacctaaccagttatttaaataattttttaaaccaccacgaataataaatggcatgtgaaactgatctgttggtaactggaagaaaactcagcatctgtatttatacaataaaattgatt

SEQ ID NO: 341658 - DNA, 325 bp, Homo sapiens
cctcccagtcctgctgctcgtgacacaggattcgcttcagggcgtagaagtgtccatcctgtaacccctccactaggtccacatggctgaacccactctcccccaggttctggatgaagaaatagctattgtcaatgatgacatttccctaagagcaggcacacagtgcatggcccatgatgtctcagtcatcctcctcaaggactgtctgaggctgccaaagggctcgtccaggatgagtgggctcttccaggcaatgcactaagcgcccagggatcatgattctcatctagagtaaacaggtcctggtgatgccagttcagca

SEQ ID NO: 341659 - DNA, 808 bp, Homo sapiens
ttggggaagtggatcgagagttctgtgtccaagtgtatatttgcatatttacatttagctagaaaaataaaaactgcccttagtacaggaagatggggaaggcagatagcctctgctctaggagcttaatcagcaagtcaccagggctattttcagagcttccagtgagtttttggctatgctaagggagttcacgagccacgtttggcagcagagattggagaaagttgttccacgtaagaaatgagaggaattcggattttgcccctaagaagaagacaacaatgaagagggggaaggggattagctgaataacatgcaaagagtctgcaccctgagttatgaaaatgatcaatggatttttaaaaagtcataccagaaatgtctgttgtttagtattatttagtgtttagtgttattgctatgatgtaaagctcttcatttcttcaaagcttcctaagttttccacatcacagaagccttgcaagtatttctgccatgttctccacctggatggtggtggtgtggaacagggacagtcaccaggaatggccagaggaccctggatcgaacaattcatcagaagcaggagcaccctccagaagtttgtggaaaacttgagatggacattagactttgcaaactccaaagggtgatgctggttcaaggcacatttgccctgacctgaagggtcaatgtgaccacttctagtctttatgagcagggctgtgtgtgtttcagtggcagtgtgtctctaagaagtgtgggctttcattgtctgtataattaaaccctgtgcttgcaatta

SEQ ID NO: 341660 - DNA, 398 bp, Homo sapiens
tcttacacagtcttgtaattatttttcatgttttcctctctcattggatggtcagatctccctgaagaagacaattgtgtctttacatttttgtaccccctaggctagcacaactgcttgacatataataggatttttaaaagtagtctgagcattatatatctacaattctatgaaaaaatcataaatataagcataaaattcatgatggttttctacttttccctttctgttgcaatgacacattggttcagttaccaagaagcaggccaattaatcagccctactttcacttccccaaaagagactgacccccaactctaactactaaagcagtgcttgacctatttgctcctaccatcttcttcccatgctggttcccatgcgacaactcacct

SEQ ID NO: 341661 - DNA, 344 bp, Homo sapiens
gcttcctcccacacatacccttgacatgtctcaaggcccagatatgaggctgctgatcagagtcaggatgccacttttcggtataagctcactggctccataagaagaaaccttatttttatcactttctactctaacccaccaagtaagcaaagataacaagacttcttggtatatatcaataaaaaagctgtgctgtgcctggcagaaactggcactacgatccaaagaaaaggcatcaaaactaaatatgaactaattgctggtttcccttatatttactcactgttgttgttactgacaaacacaatgagagataccagacttcaagtccctgaaaaggt

SEQ ID NO: 341662 - DNA, 315 bp, Homo sapiens
tcagtagtagtaatggccctctctgccccattcactagcctctgtcatttcattggctccccagtaaggagacagggcaggtgtccatttcacagatggggaaaactgagggataataaacagggttgccatgaggatgaaatgaggtcatatatatgaagccttgggcggagcctaacacaaattagcaagtgctcaatatatgctagccacgcaacggctattaggcatccaatggcacactagtggatcagtggctggtggggctctcagcagccccttccaggcctcccagcccccaggcagaaggtggag

SEQ ID NO: 341663 - DNA, 370 bp, Homo sapiens
agaacctgtgaaggagttgagaggcaatggccatgaggtaggagggaaaccaagtgaacagagtatttttgggaggagcgatgacatgtcaaatgctgctgatcaagtgaaataaggactgaggatagaagatttaaacaatataagtttccttggtgaccttgacaaaaacagatttggtgatgtggtgggcaaacacctgatagtaggagagggttgagacagcaagtatagacagctctttagggagtaattttgctgcaaagagaacagaaaaatgggatagtggctactaggggaaaagaaatcaatatatgggttaattaattaattaattaatttatttattttttagacagagtcttgctcc

SEQ ID NO: 341664 - DNA, 442 bp, Homo sapiens
caggctggagtgcagtggtgtgatcttggctcactacagcctcagcctcccaagttcaagcgattctcatgcctcccgaacagctgggtttacaggtgtgtgtaccaccaggcctagctaattttttgtatttttgtaaagacagggtttcaccatgttggccaggctggtctcaaactcctgacctcaggtgatccacctgcctcagcctcccaaagtgctaggattacaggcatgagccactgtgcctagtccttgtggacattcttaacttagggctttgaaagacaagagaaaggttagttaaaaggattgactctatactatggagtgaattatgtacaggtatagcttaggtataactatatactgtgtatagagttataataattttcaggcataattaattgcgactcatttctctttactttttgaaaaaaaa

SEQ ID NO: 341665 - DNA, 614 bp, Homo sapiens
cttccccagtagctgggaatacaggcgtgtgccaccatgcccggctaattttttttgtatatttagtagagacagggtttcaccatgttagccagaatggtctcgatctcctgaactcgtgatccacctgccttggcctcccaaaatgctggaattacaggtgtgagccactgcgcccggctaaaatttcaaattaaatatttctgagcttaattcttcctatcccaagaataatatctttttccccccttctggaagttctttttgatacatcagtattgccagttaagagtagagaaagaatataaactctggaatcacattgcttgactccttcacttataaactagatggctataggcaagtcattttagctttctgtgcttctgtttcctaatctataaaatatggataaagtatgctttcctcatatggttgatgtgagagttaaatgagataatatagatgtagcactttatacaatgcctggcacatagtaagttctcaataaaggttgattcttgttatcatcatccttcagagaacactggaaaatccattattttggattgttgctgtagttttttccacatggaatctctctggaaaaccag

SEQ ID NO: 341666 - DNA, 616 bp, Homo sapiens
  misc_feature (17)..(17): n is a, c, g, or t
  misc_feature (31)..(31): n is a, c, g, or t
  misc_feature (136)..(136): n is a, c, g, or t
  misc_feature (176)..(176): n is a, c, g, or t
  misc_feature (267)..(267): n is a, c, g, or t
  misc_feature (317)..(317): n is a, c, g, or t
aaaagataatgaaacanaaagctggttcttngaaaagataaacaaaatgatagaccattagtgagattaaccaagaagacagaagatccaaataagctcaattcacggtggctcatgcccacaatcccagcatttngggaggccaaggcaggcatatcacttgaggtcaggagttngtgaccagcctggacaacatggtgaaaccctctctctactaaaaatacaaaaatcagcagggcatgcaggtgggcgcctgtattcccagcngctcgggaggctgaagcaggagaatggcgtgaacccaggaggcagagctngcagtgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaagttcgtagttgaagctgaaacctgttgggtgaggtggagttcgccaggtgaagtggtagacttggggaagaggagagg

SEQ ID NO: 341667 - DNA, 627 bp, Homo sapiens
ctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaagttcgtagttgaagctgaaacctgttgggtgaggtggagttcgccaggtgaagtggtagacttggggaagaggagagg

SEQ ID NO: 341668 - DNA, 871 bp, Homo sapiens
atgcagcctgcaggacacaggtcggataagcctggtttatactctagtggggagctgttagcaatggaaatggtcagttgttcagtagattagaaagtgcagagaagagcagggcagagaagggtgagacagcgtggggtccaggtgtatgccccacctggctgctgtgtgttgcttgctgaccccctcatgggccttcgagtgtaagggagagtcctcttcatgccctcgcaccctcctgggtctctagggcttgtgtgtccccaggggaggagccccctggacacaccctggcgggtgctggctggcaaagagggaggcgttgagggcccgggcagcgcctccatcctggccaggcaagtgcagcttcaggttgtgagaaccgtggtcacctgtgtgttttaaagatgacggcagtgataggtccccttttgggcctggcatggaaattagtcacattcgtagaccctgtcacagagtgggcactggtgatgtcatcttttatagttcttattttcaattgattcagctttttctagcagcatggcgtgttttacgaacgtgtgttttgctgttactgctgctactcatagtatggttttgtctaatgtaagacagaagagaataatctactgttatctccatgaagtacaaacacaaatacagttgaatatagtttttctaatagaaattaaggttagttttagccaaggagcacctttgctgttggcttatatgttaatgtgtttagcaccttgaggtgtccttactggcaggtagggttgcatcttgagtgtaaagatttaacaggaaaataagtccagtgcacatgtcttaaaattaatagcaatttcagcaatatgttaaaaac

SEQ ID NO: 341669 - DNA, 484 bp, Homo sapiens
ctaaagttaaacgttttgggtttggcatttcttaatccagtgcctagaactttgggtcaaaattgaattgaatactttccacacatctatcaggagaatagcattcctgcctagtgatctgatgaccatgggaagtcatccatagctttctgaaatatacactcttgttctagggagaaatgctgtcccaataacctccttgtatatgaggggacagaatccagccatcctgtggccccaagggaggttctgtacaactctgcgggagtggtcacccatgatgtaaagtctggtttctttacacgaggaagtacagagtggcaggagcagttcacaattgagctgaggaatcactctcttccttagggctctgagaagcgtgaatgaagaataatggtgtttaggagccctccagagcccaaccatgctggcatcctgagcttggacttctagcctccagaactgtgagaaatatatttctgct

SEQ ID NO: 341670 - DNA, 428 bp, Homo sapiens
ataaaaataaataaaaactaggcccataattactatggttagcaggcaggtaagcggttggcccaggtagcactttgacagaccaggtgtgctcaccctggaaacagggttctgggcatcagttcatacagtgagttgtcagattaggagaatgagaaaaacagatttgggtggaggttagaggtgaagttaaaggctaacagcaggacaggaactttgggctaagcctggctctgagcaggctctgatggtctggcattgttttctgggggctcttactgcctagaagccccttggaagtggccatcctactcactccactgtctccttctctcctcttcatcctccttaaggcctttcaatgtcacttccttcacagctgatccaggagacctgacatttcccccgtctttttttttgatacggag

SEQ ID NO: 341671 - DNA, 453 bp, Homo sapiens
ataaaaataaataaaaactaggcccataattactatggttagcaggcaggtaagcggttggcccaggtagcactttgacagaccaggtgtgctcaccctggaaacagggttctgggcatcagttcatacagtgagttgtcagattaggagaatgagaaaaacagatttgggtggaggttagaggtgaagttaaaggctaacagcaggacaggaactttgggctaagcctggctctgagcaggctctgatggtctggcattgttttctgggggctcttactgcctagaagccccttggaagtggccatcctactcactccactgtctccttctttttttttttacaatggtatgggggtcagaacatttaacataagatgtactctcatgacaaaatttcagggtgtacgattatgttattggatgaccatgggaaccggtgtcataggtgcag

SEQ ID NO: 341672 - DNA, 188 bp, Homo sapiens
ggttcttattcagtatttttatcagtgattgggagttgcggttgaaaccaggctgggagagacagctgatgacagtcagaatccagaaaataatccgtacaaacgatgacaatggtaaagtgaagttgataatgctttaaataacaaagctgtatgtcacgctgtgaatatacttgaaaaaaaatcaa

SEQ ID NO: 341673 - DNA, 511 bp, Homo sapiens
  misc_feature (50)..(50): n is a, c, g, or t
atgaaccatatacaaaataacttcctagttacataaaattcaacactcantatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaaaatgcacattgcctgatttgtgaa

SEQ ID NO: 341674 - DNA, 467 bp, Homo sapiens
  misc_feature (37)..(37): n is a, c, g, or t
  misc_feature (42)..(42): n is a, c, g, or t
ttcagtagctactgctgactaatgttgaccagattgntccangaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaaaatgcacattgcctgatttgtgaa

SEQ ID NO: 341675 - DNA, 480 bp, Homo sapiens
cgattctgtcacagaggggcccacgtctaaaagagcacatataaagccaaatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatg

SEQ ID NO: 341676 - DNA, 445 bp, Homo sapiens
ttctttctttcttcctttctttctttttttcctttttctttttctttcatttcagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacag

SEQ ID NO: 341677 - DNA, 530 bp, Homo sapiens
agatggtctcaatgggcttaaggacttttgaaggtaatttatggttctaagtagaaacccaaaaatcatagtgatatttttaaaactgcaattatagttgaaaaatagcaaaattttacaaaatacatgacaattttgccaagtcgagacccagctctctaccatgatttcctcaactaacaaaaaaggagataaacctctcacctaaaccagtattgcaaagactttttcatggctaaataaacacatacgttttgaggaaagtgagattttaagaatagtcattttatagctaaaatgtacactctggtttgtgctgacatttctggcttgtgtgacatttcaaatcacagagtgttatactagaagaaaactgaggaatccagtagcccaacccactcatttgtcagatgagaaaactgattcccagaaattgtccaacaagttatttgtttatcacatagctgctgctaaaacccaggctgcttggtttctaggcatgtgtttttcatgctacatttaaaaaaaaa

SEQ ID NO: 341678 - DNA, 430 bp, Homo sapiens
tgttcctcagtgattcacacacctttttcttctaatccatcaagaagtctcgagtccaagaatattgtcatttattcaagcatgcattttgtgctccatacattcattcagttattcattcaacaaattttgttagcactcactgtgtgccagacgctatgcatgtaactgtactgtgtgccaggcaagactaggccctaccctcaaggagttcaaagctaaacactcttttttctctgttttccaggcccagaacaaaacaatgttcattacgtatttgctgaattactcactttagccaacatctattgtaaatttcgtgtatgtataacctatattcagaggacagacggggagagaattctcaggtagagcatgaatgtatctccatccctccctgccctcaaggagtttctgatctagcagagga

SEQ ID NO: 341679 - DNA, 695 bp, Homo sapiens
gcgcaaacgccgggagtagccgaaggggacgccgggaacaggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatgtccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataggaactacaaagctaatcccatttcatcctggtgaaaacatctcgagggcttcctttttgcatacctgtattaagctctttattccactgctgagtttttgaaattgacaaacaaatcttaaaaaattaatcccaggctatactctttgagctaaaatctggttatttctttctcttcaggtctttctttccttctctctttctttttctttgttgttgtaaaataatatattatgagaaaaacatttgatctttttaaagggaaataaattgttattaaaaattaaaaaaaaaaa

SEQ ID NO: 341680 - DNA, 1164 bp, Homo sapiens
tcgagagttgggttcagtcctggcccgttgtggggacggcacgcgggggaaggggaggggacggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttgggccagctgaggggcccacggacatagggcacccacaataggcgtgtgtctgctgtgtgtttgtgttcggccgtcctgcttctctgtttccacacgtacacatgcccctgtgttactttggttcatcttctgtactctgtcagttttctgctggtcagaacatctgtgactgtgacagagctgtccaggattgcagtggataggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatgtccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataggaactacaaagctaatcccatttcatcctggtgaaaacatctcgagggcttcctttttgcatacctgtattaagctctttattccactgctgagtttttgaaattgacaaacaaatcttaaaaaattaatcccaggctatactctttgagctaaaatctggttatttctttctcttcaggtctttctttccttctctctttctttttctttgttgttgtaaaataatatattatgagaaaaacatttgatctttttaaagggaaataaattgttattaaaaattaaaaaaaaaaa

SEQ ID NO: 341681 - DNA, 602 bp, Homo sapiens
gcgcaaacgccgggagtagccgaaggggacgccgggaacaggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagacaagttgcaagaacaagacaaagaattcctggatgttcttcacacagattccttgtgttaacattttgctatgtttgttttattcctgcggaggccaaagcaactccatcttggatactgatctgccatattgacttctcattagccccagtttcaagatacctctaagatttccaggttatctactattccctatgtaagaacaggtacttactataaatcctgaccttaggtcaagcaaccttgatgttattgtactttgcttgccctacacatcccttcagatcaccctttccctatgatataagccctgggtctggggggtagtggtgcgtggatcccttgtcttgtcctgccaaagcctgagacacagacatggcttctgtttgtaagttcctattaaatatgtctttct

SEQ ID NO: 341682 - DNA, 345 bp, Homo sapiens
tttcactctagaattgcatggcctgacttccactctggaaattttcttgctcttttttttttcttcaaaataactttccagtttctttcttttctttctttcttttttttaagaacttgtaacagacagatgtaggtcattccatctggcttaatcacttgattttcttatctgtcttatcccattgctaatctgtttttattttgttttcaggagacttcttcaacttgatattccaaactcatttactgactcttttgtttttgctatgatagtttcatttcccaagcatgaataaactgtttttttcaatatccatgtgtatgtgtgtgcttgtgtgtgtgt

SEQ ID NO: 341683 - DNA, 172 bp, Homo sapiens
gactcagacatggatcttgtcttaagggaacttgaaggcaagtttatctataaactcaaatgtagtttatctataatataacagaaaaatttctgtgagagtctagaagagacagattatttatggttaaaaggcaatacataaatgaagagatagggctttgaaattgcac

SEQ ID NO: 341684 - DNA, 304 bp, Homo sapiens
ctcgactcaaggcctgacacaacttctgttgtcttcttgatcaccttccttgaagagaggggccaaagccggcacgttctgcggagactgtctctagacctaggaaggggcacaccagggcagcggacgatttgctccgcgtctctcaaaactactgccagcccaattagtaaaccgagagggcagccctgagatgcaggatggccagagagttgaaatgagtctgggagttaagagtgggatggggcggacgaacaggcgtggggagggtaaacaacgcaccaggagcgggagtgagaacagg

SEQ ID NO: 341685 - DNA, 293 bp, Homo sapiens
tactgtagatctgtgctgggtctgaattatgcatttttgagttctgtatttgtcttgagttcttttgttgaaaagtgtaacttgcaagttgggtgtgcagtagaaatctcatccctgatacacagaaatagggatgccatggtttttgtgcagctcccacatcctctctggtttcctagggttctactttttgaccaattcacacacaaaattgcatgagctaataaataaataaataagcacagcactttaaatgaaaaaaaaaaaacttccttaaaattatattattatca

SEQ ID NO: 341686 - DNA, 763 bp, Homo sapiens
tagatatgactagagaacctattgccactgttaaaggaagaaattaattatacataaattagtggcaaccatattttactttgtaattaacataattcattattaaaagggctctaacgaattatgctagtttgtttgaattgaagtaaatcattgaaagctaaaaaacttaatttcaagtctttcaaaaatagttcttagatgtctaataggcagacatactatctcctttgtctgaatgcagattactatacttgcaattaagatattgtatgtcaagattctttgatatcgtcatgaaacttaattatttctgggtttattttctatattttgcttaagagtgttgaataaaattttactgcctattaagatttacattaaacttttgggggcaataagcaattatcaatcatgcaaatacaattaaaatcagttttaaagcttgtggaaaacttgaatattgttatcacaaatatttgggtaaatatgtttgcttaaaacaaacaccaataaaataagtactgaacatttgcaaattttcatatccgttcagatagaaaaaatagtcattttctagaaaaaatggtgtgacatgtttcaaagggcctcaacatatgccagataaatggaagaagaagtgaggaacttcacacaagagaacaaaggaatttctctgatattctggtaagatggcacgttggagatggaagggtgaccgacgaaatttaaaaggcgaggtggcgggaagaaaggttggtaa

SEQ ID NO: 341687 - DNA, 691 bp, Homo sapiens
tagatatgactagagaacctattgccactgttaaaggaagaaattaattatacataaattagtggcaaccatattttactttgtaattaacataattcattattaaaagggctctaacgaattatgctagtttgtttgaattgaagtaaatcattgaaagctaaaaaacttaatttcaagtctttcaaaaatagttcttagatgtctaataggcagacatactatctcctttgtctgaatgcagattactatacttgcaattaagatattgtatgtcaagattctttgatatcgtcatgaaacttaattatttctgggtttattttctatattttgcttaagagtgttgaataaaattttactgcctattaagatttacattaaacttttgggggcaataagcaattatcaatcatgcaaatacaattaaaatcagttttaaagcttgtggaaaacttgaatattgttatcacaaatatttgggtaaatatgtttgcttaaaacaaacaccaataaaataagtactgaacatttgcaaattttcatatccgttcagatagaaaaaatagtcattttctagaaaaaatggtgtgacatgtttcaaagggcctcaacatatgccagataaatggaagaagaagtgaggaacttcacacaagagaacaaaaagcaaattttctctgaatatttc

SEQ ID NO: 341688 - DNA, 236 bp, Homo sapiens
atctacagcaataaaatagttttctgtccaggtgaagaaaaacttgataagcctaataatattgtagcaatgcacaagctgccacctgggagatcaaaattcaaaatcagcctgtagctcaggctctaagcttatgagactgagtgtgcagcaaagaaaatgaattcggtctctggggaagagcttctgaggattgtcactggtgttggttatggagaaggcaatacacaatttcg

SEQ ID NO: 341689 - DNA, 318 bp, Homo sapiens
agcatgatgtaaaagcaattggtctaatctactctgttttacagacggggaaattaacagaggtttcattcagaatttgaacttgccacttgcccagagcccctgagtagaaaacacagtgacatcactaactaacttgcccctgctgctacctggtacctgggctctccccacaggggtcttgatgaaatgcagagatctgtggagtcttagaaatctgggcttcatgcctagggacaaaatgagggggatttgaaggcagtgaaggaccacagtttttgagatgctctgttttctttctgcttgacatgtagccca

SEQ ID NO: 341690 - DNA, 653 bp, Homo sapiens
cctcaaatgtcaacaggggccaggcaggaaaagtaagagtaaagaaaaataagaatatttttcacttccataaaaaacaaaggcaggagaagaccctgctttactggtttgagagcccggggacctttgtcagcctccctccaaaaaaaggcaagtgaggcaactgaccccctgcttcagtgcggagaggccaacagagcatggacaggctgtggggagggtgggcttgccagccccatctcaagtggcagccgctcttcagctccagctgatttttgccctgtgggaatgtgtgcccgaccttcccagatcttcccattttttcagagaagccaaaaatttgggttttgatgggacacctcttgatttttaaatgctggctcacagtttgttaatggggtcaaataaatcccacgtgtaggtcacttgtggataatctctgccgtagacctcactctggtgtgaggtggggtaggagtgtgacaggagccacgggggatgggaacaaggactgtggtggcattcggatcatggttgtctcacagcctggcagagcagctggccacagtaagtgctgaataataagtggacacattacgggggcctccgggaagagctgctgcagcatgtggctgcctcggcaggcccagcca

SEQ ID NO: 341691 - DNA, 324 bp, Homo sapiens
tgcactccagcctgggaaacagagcaagacctgtctcaaaaataaataaaaaataaaagtaaaaagaatgcttagtgttactggtcagtgaattgatagttacaaagacactatccaaaaaatcaaaggtggaagaatacatgcctgagcatgagttgccagcgctccccttcttcaagttggggaacttcacaagctggtcacagacagctcaccccagttcctctttttaattcttccatcctcttctaactcctaccacccctgggcttctctggctctgttctctctgattcaccacctcctctttctgtgcccgccttt

SEQ ID NO: 341692 - DNA, 303 bp, Homo sapiens
tccaactggggatctctactgaacttcgatgtccagagtttttattggagtttcactatgtcagtgtgattgatgggccccatgattgaactcagtctctagtttgcttccattccctggaagttagaaggtcaggctgatatcacatgatgcaaagctccacctctccttatagagttggtctttctgcacagccagccctcatcctgaagctatctatgtgtccataatgagttacctcagtagcatatcaaagacactcctgtaactcaagaaaatacaaggatttagagtctccctcag

SEQ ID NO: 341693 - DNA, 282 bp, Homo sapiens
caagtcttctttcttctccctgtccataaatgggctctggtatggtctcaaggtctcggcccaccactcagcatcaacccggcacttgcgggtcactgtcatccagactgggtcgtacctctgtgtgacatctcggacccagccgtcactgtcaatgcccaccacataggtcatgggcttggtggcgtacttgtaacaggtcagaggctggcccaccacaccgtgcacacagtctacacatacccacttttcctcctgctcacagaacacctctagccactg

SEQ ID NO: 341694 - DNA, 607 bp, Homo sapiens
gttaaagcttaaaagtgagaatggaaaagggatgaatgaatgaacatgatgaggtgagagggaagaagtagagggaaaaggagaacaagaaactcttctctgcgtggcacctaggatgaatggtttctggggacatccctgatggcagttttgtggagaggtgcaaagctttatgtggtaagaaatgagctgtaggctcagtgcagtggctcacgcctgtaatcccagcactttgggaggccgaggtgggcggatcatgaggtcaggagttcgagagcagcctggccaacatggtgaaaccatgtctctacaaaaaaatagaaaaagaatccctgcgtggtggtgagcacctgtagtcccagttactcaggaggctgaggcatgagaatcgcttaaacctcggaggcggaggctgcagtgagctgagatggtgccactgcactcccgcctgggtgacagagctgggtggtggctcaagatatgttttgtaaacctgaagatttgagatcatataagccaaatcgaaacttaattggcattcacaacttttggttctagagactccatgatcaactaagagccaccaagcatttcccatgtagactat

SEQ ID NO: 341695 - DNA, 708 bp, Homo sapiens
gttctagtgactgctggtcagtgtgtctcccctacctcacaccgatggtgggacaggcccgtgtctgcctttgtgagatgggccctgcaccttgcatataccaggttcccagccacagggggcagtaggtacaacaggtgtcatgtggggcaggctcctccttcaaaatctgaggcccgggggagccacccaggtcctgctcaccacccagcttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccatcgtcggccgctgtttttcctcaaga

SEQ ID NO: 341696 - DNA, 4483 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341697 - DNA, 4093 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341698 - DNA, 4360 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341699 - DNA, 3678 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgtgttgggcccatttcgactgaaggtgctgggtggctgccctcggtctaggtaatcacaggcttcctgcattagaaatggtcggtgatgtcaaaagcattcctgtagactccagtcagcttctactgctaggtcagtcatcttcagaccccattactg

SEQ ID NO: 341700 - DNA, 4077 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcatgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341701 - DNA, 3471 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtctgggcactcggcgtgcacacgccgagtatccacacgtgtccccacagttctgtcatatcatagtacaggaatttcaacctgttatccatcgactacgtctttcgacctcgccttaggccccgacttacccagagcagatcagctttactctggaaaccttagatattcggccggaaggattctcaccttcctctcgctactcattccggcattctctcttcttaaaaacccactgctcctttcggtacagcttcttctctttaagaatgctcctctaccaatcatcttgcgatgattccacagcttcggcgtgtgca

SEQ ID NO: 341702 - DNA, 1471 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttaacctcgccgcagatcctgcttatacgccaacggtatgacggcctcacaca

SEQ ID NO: 341703 - DNA, 1260 bp, Homo sapiens
aagggaattcgtgctggtgctaagggaattcgtgctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341704 - DNA, 1166 bp, Homo sapiens
gcgaggtctgattgattgctgcccatgaagcgctggtgatggatgacggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341705 - DNA, 1001 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341706 - DNA, 995 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaaaggcgggatttcgctatgttgcccaagctggtctcaaactataggcctcaagtgttgaaggacat

SEQ ID NO: 341707 - DNA, 4703 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaaaaaaaaaaaaaaaaacaaagagagaaaaaaaaaaaaaaaaaaaacaaaaaaaaaaaaaaagaaaacagaaagaagaaaagagaggaagacagaagaagacaaagagaaaagacacacagaaaagaagaagaacacaaagaaaagaagagcgacgaccaagggaaaacacacaagaaagagaggaaacccaagggagccgggccctctctagcagcgagcc

SEQ ID NO: 341708 - DNA, 3797 bp, Homo sapiens
gacgaccaggcgcatcccgctggccatggagtcaaacagactgttgccatctgggtccagacacatgaacttgcagcactctttggggtccttgcggtactgttggcagccctggggcctctcacagagagcagccacacacatctcaggctcccctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341709 - DNA, 3159 bp, Homo sapiens
gttctagtgactgctggtcagtgtgtctcccctacctcacaccgatggtgggacaggcccgtgtctgcctttgtgagatgggccctgcaccttgcatataccaggttcccagccacagggggcagtaggtacaacaggtgtcatgtggggcaggctcctccttcaaaatctgaggcccgggggagccacccaggtcctgctcaccacccagcttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341710 - DNA, 3562 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 341711 - DNA, 2295 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccaggtgagactcttgataggacgtcccaagtcagcctccctatttggggctggaggctgggcgtccctttgcttcctcagtggtgaggactcaggagagtttatggagcatcgcgcagcagcaatggcagcgtttgtcacagagatgtctcagagactttgatgccactactctagtgggcgtgtctgacacgacccctccagctgcctccttcccattctggggtgacaggcagcattcacaaatgaacttgaactcaagtgtggctgtttgttcacaagtcaccactgacagcttcaaacttgtcttcaaacttacgcctccagggtttaagccgttctcctgcctcagcctcaccagtagctggaactacaggcgcatgccaccatgcctggctagtttttgtatttttagtagagacggggtttcgccatgttgtccagaccaggtcttcaactcctggcctcgagtgatccacccacctcagcttcccaaagtgctgggattacaggcatgagccaccgcgtccagcctagacttctaatttatgtccacattggagctcttcctgttctctagtatgatgatatggagggtagtgacagttgtcattgcttacagtcatccatttttaccttagaatcttcgagaaaaagatgaagtattattctcagtttcgagatcagactcctcaccaccaggcgggggctttaaggtagacactacagggaatctgatctcagggtgatcctctcccttccacttgcaaaaagagaggagcaggtgggccactgctctctgagatgttaacacccctcacactccacgggcatgcttgtcattctgcacaccggtgtagctgcagctctgtgtgaattcagatctcaagagaaatgtaaatcaaaagtatgagtttctttctttcttgggtgccacagtaggaatgaaatgatggggacttttggaagcccctggacttgtggcccctgtagaagagcagcttgggcagggtgtgatggccatctctgtctctaggggccc

SEQ ID NO: 341712 - DNA, 960 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagtgagtcctggattggggacctgaggggctggagtcagagtctgatgactactgagcacatggcctctgaccactcagtaaactcctggagcacagctggcagacagcaggttgggaagaccagcctcgcccactggaagcccaggagatccatgggtagg

SEQ ID NO: 341713 - DNA, 1315 bp, Homo sapiens
aggcggggcggggcggcgcggcgcgggccgagcaggacggccgccatcttgcgcgcagctggagtcggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggccttccagccgccccggggacgatgaacggaggataaatggtgcccaaggcagacagcggcgccttcctgctgctcttcctgctcgtgctcactgtcaccgagccgctgcggccaggtgcgccgcgcgatgggggcggtgtgggggctgggcggcgagcggggccggggtcgccccgggacctcctttcacccgcggcgccctcctgcaggggccgcgcctggggcaggggcgggcggggcctggctcgcgggccgcctggcactctctgcggacgcctgctggagcttacctgggctcgcggcgcctcggacttcgtgcagctctgctgtccaggatgttgcctctgggcccttcccgggagcggcggcggccaggagctacgccacgggcgcaccctctcgccagtccagcgtcggagtcgggctggggacagtggctctcaggggcacctggtttcacagacgtcctcccagcagtggcctagtgccagcctctcagtcctggaaactcctcgcctggacagcggtggttgtggctgtcattcagtgagacgttgcgcctaaggaagtcctcaggtcccaccgggcctagaggaggcaccaggagtcagcctagcgttgtgtggccggcgcgagcgtcccgggagcagagacctcgccactgtgcggggcccttagccgtgctgcgtgtatgtgatgaatgagtccgtgctttggaactcccctcggagctagtgtgttcttaagtctgtggtggggaatcagaaccgtggcaaccaggagacccttttctacctatttcggtgtacctccccttgaactgcaccaaaaaatcaaactccctaaatgcagggccgatgtatccatcaggcacaggaatcctggtatcacttgcccacggtacttttagtagccttcgaatgttattttatttttttttaaagtcagcagaaaaaaaatgaacttttaggtcaaataaaatgttttcgtatgtatattaatacagtcatctttatactaatacagtgaaaaagcatgactcttaatatttcttaatggaggaaaggtcccatgaaggcagaagtgccagggccatcttc

SEQ ID NO: 341714 - DNA, 422 bp, Homo sapiens
taatattttgaaaggagtatttttcttctgagcagcaggtctcaacagtggttttaaaatattcagtaaaccatgctgttaaacagatgtgctgtcatacaggctttgttgttctatttgtggagaacaggcaaagtagatttagtataattcttaaggcccttaggatttttacaatggtcaataagcattggcttaaactcaaagtcaccagctgtattagcccctaacaagagagtcagcctatcctttgaagccaggcactgacttctcctctctcgttatgaaagtcctagatggcatcttcttccaatagatggctgtttcacctacactgaaaatctgctgtttagggtagtcaccttcaccaactatcttaactaaatctgggtaagtaacttgctgtagttctccatcagtac

SEQ ID NO: 341715 - DNA, 598 bp, Homo sapiens
caacagagttggtaggtttaccctggtctccagagaagataaacactcgtttcctgctctacactatacacaatcccaatgcctatcagcaaatcccacatctggtttgggccctatcagcagagaacactataatcagaacatcgcttgagagcccagtggttaagcacctaacttcaaaggccatgtggatttgaactctggctccaggattcattagctgcagtactttttggagatcagtgcggttaattcttcaactatccaagcctcatattttggaacagacaagatcacccgtatcaacatagctggatggaaaacagatggcaaatggcagagagacatgtgcaatgtatgacatgaataagctcctttttacactagcatgcgagctttatgtttaacatgaatgtactttgcaaggtattgatgtatattcatggaaatcttccattcagttatccacaattatccgtgttctggggcctcaaattagttatccatttcccatttatttttattataaattgcacagattacaagggaagcaaatttgtataatcactcttgaataaattcttctcttgacaggaga

SEQ ID NO: 341716 - DNA, 2798 bp, Homo sapiens
cttcctttccccctttgctttcttccccctccgctgttggcgagggcaaagtggccgtggcggcgccatgcccgggccggagtgagtgcgcgcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341717 - DNA, 2885 bp, Homo sapiens
agcggctcctggaagtgtggctgcattggatagcatgactatctatccgcccgctctgattcataacagcatacggtgcaaatcaaatcgaaatgctaaagtttcccatttatttggtgttggttaaccaggaggctaccagcagacctgaaaatagcaacaccttgttaggatgttaggaagtcagctcccttcccaggatgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341718 - DNA, 2044 bp, Homo sapiens
gcatcgggctcttacaagaaaggaaatgaggcctgtttatttgtgacatcgcttccacaagggacgaggtagaagtgggcctgtcacccagttccttctcctgtcttggcttcgattctgtgggggttggataggacagggggtggaacatcgtgctgacaacccctctcggcccgtggtgtggcagcagctcagcctctgtgttgggggctgcactgcttgatcttggatttgtttctggtgctgtgaatatagtagtggacacatgggcactttctttgcctttatggagaaaaagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341719 - DNA, 1631 bp, Homo sapiens
tcaccaagaaaaggaaaaagacagcgtgccctaaacgatgacccccatgtttgcagttgacaaatgtgtagactaatggcctcttgtcttctccctgccttcctgttctgttcccctccttcctcttgcctccctcctgccctcaaccctctggctccctagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341720 - DNA, 1480 bp, Homo sapiens
agcggctcctggaagtgtggctgcattggatagcatgactatctatccgcccgctctgattcataacagcatacggtgcaaatcaaatcgaaatgctaaagtttcccatttatttggtgttggttaaccaggaggctaccagcagacctgaaaatagcaacaccttgttaggatgttaggaagtcagctcccttcccaggatgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaactgagtagtcacccagctcatggtatcagtccttggataccctcacctggaaatg

SEQ ID NO: 341721 - DNA, 374 bp, Homo sapiens
gctcattggtacaaaggaccgttgaacctttgtttggtgttttgggtagacaaaatatgaaggtttcagactctttggttcaggccctggttggtgtttctggccatgcatggtctgttattggagtcattgggataacctggagtcactgggggctccatactttcatccaggtcgtcttgtcttgctcactcccttgtccccagcagattcaccaagtcctctttttgctctaggatccaacagccccataccagcctgcgaactgagtagtcacccagctcatggtatcagtccttggataccctcacctggaaatgaacatttccatggcataaagaagcaagtaaaggcaataaaagtagaatgattga

SEQ ID NO: 341722 - DNA, 2527 bp, Homo sapiens
cttcctttccccctttgctttcttccccctccgctgttggcgagggcaaagtggccgtggcggcgccatgcccgggccggagtgagtgcgcgcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtttttactaggaataaagaggcttaattttttgaccgatcaggtgatgtgaccagaagaattcaagactgatttggttacagggattaaccacagagtatccttcagg

SEQ ID NO: 341723 - DNA, 2741 bp, Homo sapiens
ctaggcgaggcctggcgtgttatatcggacgagggcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341724 - DNA, 2734 bp, Homo sapiens
ctaaattggggaatatttcttcatatcatttcacattttgtgcaaaaagcaagacgttgttgagagtttaaggacaccacactgtcaaatttgcattattccatgttgcataaaatgagtctgagagcggtttcatcgtgggtcttaacccccaagggacagagatgccagtccccggggattcctggacagctactgagacctcttcccttcctataggatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggtgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgcattcgagttatc

SEQ ID NO: 341725 - DNA, 1500 bp, Homo sapiens
agcggctcctggaagtgtggctgcattggatagcatgactatctatccgcccgctctgattcataacagcatacggtgcaaatcaaatcgaaatgctaaagtttcccatttatttggtgttggttaaccaggaggctaccagcagacctgaaaatagcaacaccttgttaggatgttaggaagtcagctcccttcccaggatgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaactgagtagtcacccagctcatggtatcagtccttggataccctcacctggaaatg

SEQ ID NO: 341726 - DNA, 742 bp, Homo sapiens
ctgttagaagagggagacgtgtctgggactgctggggaaataggaaacttgtctctgaactactgaatcccagaaaagaggacatgtccccagggaggtttgctgggggaaggacgggcatgtctaggcccttgggacattaggcctgctcttaccaggggctgataaaaggatgtggatgtggtaattgaataagggcttttgggagaaaagatttgccccaaggttgggagactgagaacgagggtgttggactgacaggcgggtgccttgtcgtgggatcttgggggaagtaaggatctgtgtggagcttctctgttgagttctaggtccgctagtaggaagacattctgggaattggtgaagagaggagatttaatagtcttttcttgggacacagtgattccagaagttgtagttgaggaaagttggttggaagtgttgaactgtatacagtcagtggagaaaggaggagctctactgtgaaggttgctaggctacaaagagcttgtaggcaacgcctagggctgttgagagaagttggtaatgctttcaagtccaaatacaggctgagctggggcttgtcccttgttcatgtcatgctgctgtggagctcttacgtttccagtagtctatcttgagcaaagagtatgaataggtgctgaggactaaggaaaacattcactctttgggtcctgagatgcattagacccagatctctagggtggtagctttcaaactt

SEQ ID NO: 341727 - DNA, 689 bp, Homo sapiens
ctgttagaagagggagacgtgtctgggactgctggggaaataggaaacttgtctctgaactactgaatcccagaaaagaggacatgtccccagggaggtttgctgggggaaggacgggcatgtctaggcccttgggacattaggcctgctcttaccaggggctgataaaaggatgtggatgtggtaattgaataagggcttttgggaggcgggtgccttgtcgtgggatcttgggggaagtaaggatctgtgtggagcttctctgttgagttctaggtccgctagtaggaagacattctgggaattggtgaagagaggagatttaatagtcttttcttgggacacagtgattccagaagttgtagttgaggaaagttggttggaagtgttgaactgtatacagtcagtggagaaaggaggagctctactgtgaaggttgctaggctacaaagagcttgtaggcaacgcctagggctgttgagagaagttggtaatgctttcaagtccaaatacaggctgagctggggcttgtcccttgttcatgtcatgctgctgtggagctcttacgtttccagtagtctatcttgagcaaagagtatgaataggtgctgaggactaaggaaaacattcactctttgggtcctgagatgcattagacccagatctctagggtggtagctttcaaactt

SEQ ID NO: 341728 - DNA, 249 bp, Homo sapiens
ctgtgtagaggggaattgtataaatctacccactttgaagacctaagtgtgtaatcaaggggtgtttattggaaaatttatattaagtaactgataacctgggattttgattaatttgtgtcttagaaacattatgactaagaaactagagacaagtccttgttcatttgtaagattcctaagtgtatctcatatctttccaaatgttcttgactcttgattttaaagtcccatttatctcaaccattt

SEQ ID NO: 341729 - DNA, 450 bp, Homo sapiens
caagaaacagctgccacctaaaatttataatcaacaatagaaagaaaaatagagattttttaaaaacgggaattccgtagaagcaggtatactgtaatatagggaacagatggaaaaaaagtaagttacactctcagggaggtgagatgaaattaagagcaatctgtgaataagaaggagctttagaaaattaaaaaatatgatagcccaagtaaaaatttcagtacatactagggaagacagtaaaaggacactgccagagattgacctagagagagggagatggaacatgggagagaaaaaataagattagaggattatcaggcagttgaacattcaacttacagaagttcagaaaggagagcagagcaaagtgagggcagaaaattatcaagtagcttaagaacatgtagatatagaagagtgcacttttgcaaaagtgcacttttg

SEQ ID NO: 341730 - DNA, 254 bp, Homo sapiens
cattttcacccactgaactggcaaaatgttgtaactgtattaccttatgaagcaagaatgtagttgaaaagattcaacacagctgttagtagaattggtacctcttttctgatgcctgtctggtggacaatcaggcagtataaatcaaaagcttgaaactagttcttgccattggagtcataattccacttttcagaattttatattgagggaataatcagagatgtaaataaagatttttgtacaaggatgtt

SEQ ID NO: 341731 - DNA, 530 bp, Homo sapiens
agtcacaattttatgctcaggatgaacaaggcacccacggcagggtttgaagctgctgccgggagcaaaaccgcccaccatctggtgtaccctgagagcttccgggagctgggggacaatgtcagcatggtcctggtgcccttaaagaccatgaacttggagtgggtggtgagcaccaccaccacgggtgccatttcccacacctacaccccggtcctcgtgaagatcagagtgaaacaggataagatcctgatctaccacccagccttcatcaagtatgtcttcgacaactggctgcagagccacaggcggtacccactcaccagcatcctctcggtcatcttctcaatgcatgtctgcgattaggtagacttgtatagcttctgagcagatagcaaagggaactgacaccactactgggagaacaacctgtctgcggggtcttttcacaagacgggggtgcacgatgcaggctttgagtctaacgtgacggccaccttggcttcatgaataaaatccggatcttcaag

SEQ ID NO: 341732 - DNA, 186 bp, Homo sapiens
tcaaatacttagaaacagagaaatcaaataagtagaaatagaatagagcagtcattaccagggatgggggttgagtgaggagaaggggaagggatgaggagaggtaggtcaaaagatagcaagttgcaattacaaaggatgactaagtctaaagatcaaatatacagcatgaggactatagttgaa

SEQ ID NO: 341733 - DNA, 519 bp, Homo sapiens
agtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggcgcggtggctcacgcctgtaatcccagcactttgggaggctgaggcggcagatcacgaggtcaggagatcgagaccatcgtggctaacacagtgaaaccccgtctctactaaaaatacaaaaa

SEQ ID NO: 341734 - DNA, 426 bp, Homo sapiens
atttgagggagaaatgggaaagaaaaagagtagatgcactgggaatatgaaccatctgttcatacaatctacctgcttattcacaacctgcttgaggcttatctcttatagactgcttcttttgataatggagtatgattgcacttgttcaactttattatttggtacattagataacacccactttaggtctgatgatcacttgatgttctttggtcaaaatttaagtctctaaaagtaaaaggtaggtaaaaataaaccaaggtaaactgaggtaaaagtaaaccaagagcattttttccaaaggagattagctaatgtgtgaagaagacatagccctactccaaagcactggaggcctgtattggagtgtaccagaggtactctacagcatttgaatctgctgtacacactttaagtaccttt

SEQ ID NO: 341735 - DNA, 290 bp, Homo sapiens
aaacccaggcaaaacaaccttacatggtcaatagaatttttaattgcaaagatttcctctgacgtgagtgttaatgaatgtcaaagcaataacataaaaagacattacttgtttaatgattgatagaataagaaaaacacaaggtcttttgtcagataaatgactactgtttggtgttcctttacctcaggagtatcaaaagtgatctcagataggcaataatagcccaggagctaaggcagcaagtatgatgtagcctgttagattataaccaaaggaggaaggctaat

SEQ ID NO: 341736 - DNA, 381 bp, Homo sapiens
tcagcagaaatgcagtataaacttggatataaaaactctcaaattacagagtcaagctctggaatagaaaaaaagagtaatgctagaaattataaaaacaccatgaccatgtgacatgaaaaagaagcagtagaacatgggactgaaatggtaggaaccagatgatcacaatgagtttagatttttaaaggtaagaaaagagctgatgtaagaaacaactgtcctctgacctggggacaattagatccagcaatttaagtaaggagattataaaaaataggtataatttaggagatgtcagcaaatctaaatactggcagtgatcttacaaatagtgatcagaaaatacatactgcacatttttgttaggcttaaagtgac

SEQ ID NO: 341737 - DNA, 192 bp, Homo sapiens
acaaccaagcctcaggacacaacacatggaggcctggcaggggtctgagggcgagggaacagcagtcgaattctggcaggaagagggcatcctactctcagatcccaagcgtagtccaattcttgggcatctttccaaggaagagctcatcccacccacttcctagatacagctagcttgagagtggaacac

SEQ ID NO: 341738 - DNA, 384 bp, Homo sapiens
tagagacagggtttcaccatgttggccaggccggtctcaaactcctgagctccaccttactggctaacgctgctctccctgagcctcgatgttgaagtgtccaggtcagcggttcacattcattgttcatccgtcaccaccgtccatctccagaaccttttcatcttccccaacggctgctctgtgcccatgaaacactccctcctcatcctcctgcccctggcacccccattctactttctgtccccataagtttgactgccctggggacctcatacaagtggaatcagacagtgtttgtccccttgtgcctggcatgtcgtatgttgcagatttttttatggtgaaaagatatacatatatttagaattagccagccggact

SEQ ID NO: 341739 - DNA, 371 bp, Homo sapiens
acgggaacctcagtcttacagcttgaagcaactgtagtctgccaacaatcacgtgatcttggaagcgaactcaagctctaggaaggaatgcagcctgaccaatgccttgattgcagctttgcagggaacccagattagccacatctggactcctggcatgtggacactgtgagttaataaatatttgctgttgtaaatcacctagtttgtggcaatttgttacccagcaatacaaaactaatacactatttgttttatctgtatatctaaatttttattctctatttcttgtcctggcatcaaaacatacatagcttataaactcgagataaacaggattgtttttgtttttgttcttgtttgtttggcct

SEQ ID NO: 341740 - DNA, 92 bp, Homo sapiens
acccacagaaacagtaagataataaatgtttgttgttttagggtaactttgtgcaattttaagctaactttgtgcataacaacataaaatag

SEQ ID NO: 341741 - DNA, 515 bp, Homo sapiens
gaatttggagtcatgggaatgggcaggtgttcaggtgatttaaaaggagaagtaaaggcatgttcctggataaatgtcgatatgcattattaaatgaaacagtggtaaaatatagactgtcagaagcatttttcttccagagacatgaggagaattgaaatgcagtttcaaaggaggagtctctttcggtgtttcttcaatcatttttttgtttgaagctttaattacagtgctccttgctacctaatgctttcagtttaaaatgacatcacaaaagagaggggaagatgtaattgctcagatgaagggcagccatcacagcagcattgaggtatttactcaccagggagttcctgctacatgattcttttctagatcaacattttgtttttggaatgcttttgtatcatgcatatttgacatggtttgtctttagagtgattgctctgatactgctattgccagagcagataataaccttcgggaaataatgtattctgaaataaaggaactag

SEQ ID NO: 341742 - DNA, 294 bp, Homo sapiens
gtcattatcagcacaaggacagacaaacagtccagtggaactaaaaagagaatccaaacatgtatggacacctgatttatgacaaagttggcacagtaaagcagtagggagaagatgaccttttcaatagatgtggatgggttattagatatctatatggagaaaatgaaatttaacccctctagccacacataaaaatcagctacaggtaaatcgtaaatctaatgtgagaggtaaccaattaagtgtctataaaataatacaggaaaatgttttcataagctttggagtagg

SEQ ID NO: 341743 - DNA, 553 bp, Homo sapiens
ttcacttccaactatgtggtcaattttggaataaatgcgatgtggtgctgagaagaatgtatattttgttgatctggggtggagagttctgtagatgtctattaggtccacttggtgcagagctgagttcaattcctggatatccttgttaactttctgtctcgttgatctgtctaatgttgacagtgggatgttaacgtctcccattattattgtgtgggaatctaagtctctttgtagggaatccttttttttttttctgagactgggtcttaaaaaaggaaacaaaaaccagaacaaaacaaaacaaaacaaaaagtaaaaaaacaaaactccattaattttcaaataaaggaagaggcaaagttattcaaagcgaacaaaaagacaacgggaatgggggttaaaaaaaaatcattaaataagacccagaacaccagtggtaaaggtgtaattcttaatgaagagaacataggtttgaatgtgtacaccacagatagcatatcatgaacatttaaaaaggcaaaactatgcaggggggtgaggaactaga

SEQ ID NO: 341744 - DNA, 345 bp, Homo sapiens
gcaaggattgaatcttattcccttatcctctgtgtctaggccagtgtctcatttgattattcagaaaacaactgataaactgatgggaactctcacaattattatgaatatcaaacaaacagatttgaatgtgccttgcaaattatgaagtataaaaattaagaggtcttaaagtgtttaatttcttagttatgagcataaagaccattctaaagatttccataatttatcaaatattcaaaggctcttaagtgttccatgcatattttaaacatataggctccagtggaatgaaattctgctcaactgcctattataaagtgtcttggccttgccatttatata

SEQ ID NO: 341745 - DNA, 173 bp, Homo sapiens
taaagccaaactccagagtgttcagggagactcaactagtcgtcttattgagttaaagtaaaagaaagaaaagaaaaaataaacagaatagggtaaaatgaaaactttggaaagatgtgaaaagatagattttaactaatgtgattgtaattgtgccatcactgagtacacag

SEQ ID NO: 341746 - DNA, 514 bp, Homo sapiens
tgtgtgtgtgtgtgtgtgtgtatctgagtatgttttgaggggtatttggttgtgcttaggaatgtgtttgtgattatagtttgggttttagatgcttgtgttttgggttgcatgcatatttatgtgttcatatgtgtgcatgttgagttgtatacacttgtgtgttttggcgcttgtgtgaatttatgtgtttttagccaatgatctccagggtctcccttagttgtgtcattccagaagtctgccctggggcccctgctgcagggagcacctagaagggatgctgggcaatggcagtggggatggaatggactcaagagcaggtgggagcagcgtcctgtctggtctagggccacctgggagagggcaggggcatctcaagtgtccccatcacacctgccctgtcagtgcaatgatctcagcctcaggagtgggggtccagtaggagccatgtcctgggggcccagccccagggccttcttggaagccttcagcagagaagaaaccgcccccg

SEQ ID NO: 341747 - DNA, 791 bp, Homo sapiens
ctcgtgatctgcccgcctgggcctcccaaagtgcttggattagaggcgtgagccaccgtgccgggccgcagcttagggtaatgtttttaaaggaacttagtgatcatttttctgtcttgaagactcatatagtcaagttggagttataccaactatggcatgatgtaacgttaccttttagagacaatttggttgtttcctgaggtatgaaaactgcagtctgctcttcagtgtgcacgctccttgcccaacaaaaccatcggcattcttgaaagttctgcctgagtatagcacctttattcctgtggaggtatagtgcattctaactaccatgaatagtgtccactgtgatcatttccctctgcacgattatctgcccacaactgagagagtcttaacttgctagaataatggggacgcttcactatctgtcagtttcccaatatggcaattcagttcattgtatgacagcatcatcagaatgttgccaagatcataaaaatagcagtgcatgttgcctgatgattttacagtgcatattgtcatggccagggcttagaggtaggggaaaaacatgtggacagctttgtgacaagagtctctcttatagtgtttctttctaaagtaactttttctgagtatgaatgtgaaaggtagccttctttgaattaaaaaatattctgaaaaatgtttaatgtctgagctgacttgagcatttttctttagtgattactgtaataatcagaaatttcttcacctttcaagaggacaaaagggaacaactataatta

SEQ ID NO: 341748 - DNA, 327 bp, Homo sapiens
ctctcttaaaagagttcggttttacgttttgtgctgttaccttttggaatttaattatttagtattttaatgtactttattggagataaagatggattatttatttatttatttatttattttctttttgagacggagtcttgctctgtagcccaggctggagtgcagtggcatgatttcggctcattgcaacctccacctcccgggtcctggttcaagcaattctcctgcctcctgagtagctgggattataggcacgtgccaccatgcccagctaatttttgtattttgggtagagatggggtttcaccatgttggccaggcagg

SEQ ID NO: 341749 - DNA, 461 bp, Homo sapiens
ccaaaggtcggccaccatgaagcccatgggcccagagggagtacccggtagtttcaggccgctcgcttatcttccttttaaagagaccttgaggcaccagtcctgcctccaaacgaaatcctattcggcgctaccctctctggaggagcccattcttaccctgcactaacaactgcacgggacttaacgactccaccacccaccaactcctccaaaagggagagacacagccaaagcatcccactggggcgttctctttcgcacacggacgctcccgcactccccctactttctggatctgtgcttgtgaaaggctccatggtcttgcctccttgcaggtagagaatgccaaagataatgaagatagtattctacaaagagaaattcctgccagacaatcccgaagaagatttcggaaaatttaacgtaaggctctgttgccgtgcaagtggaccggaatt

SEQ ID NO: 341750 - DNA, 6082 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacggagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtagggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattacca

SEQ ID NO: 341751 - DNA, 6260 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacggagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtagggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctg

SEQ ID NO: 341752 - DNA, 4576 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctgatgaagttccttatttaattttagtgttaagtttgttttcagttattaatgtatacatggcttaaattaaaccatttgtcaaagcttaggcagacaacttagtaaaatactatttataaacacttgaaaatgcctcatttgtacataagttattttactgatgtattgagttagtaaattttatactcttgttt

SEQ ID NO: 341753 - DNA, 2606 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggttggttttataaggggcatgaaagtgattttaacccaaaattttattcatgaaacttttatagttgatagattacctgtttattatgataataagattcagtacacctaaaaaaattaatgaacctgaaccatcagtataaacattctctgcttacttttatgacagaatagcatgctaaaagtggacgagagccttaaaaggcaaaaactgaaataaagctctggtatagctataggttcaggaaacataatagttacatgagagtattttagaattttactgaaatacttgattgtttctggagatcaataaaacattttaaaacggatttaatattttagaaagaatattcatcaaatacatttttttaagagggcagattgcttttaagcttcaaaatgggaatatttttattttcttgagttacagacttcacaatcatttgaaaacaatttatcaaaccttaatatgtctctcctgtgacttatttaaatctaccttttgagtatttttttgtattaaatgttgttcactattttaaataaattagcttatttcatgggatatgtttgcacatttaatggaaagactagtaatacttccacaaattggtaagaaataagttgtttcaagaaaataaaagtaggatcataattgtctggtgtgtctttttgagttatattttaaaggaaataaactagttgcaggtaaactgcagaattcttttatttaggagactaacatctaaaactacaggcttgcacacctctcaccctttttcttagaattaaatatatttaccttggttgccaagaaaataaaggcatgctttggaaatgaacaagaatatgatttagtgataattatccatatgcaaaagaatgaaaatggattaccaccttatactataaacaaaaatgtacccaaaatgggtcagagacagaagagctaaaactataatgccttaaagatagggg

SEQ ID NO: 341754 - DNA, 1570 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcaggtaagattatctctttggtcaagtcttcttgtctgttggtttaaagtagctgagcctgttttgtcttcctcaaaagaaaatagctttatttgagaattaggagtttcaatagctcacagttaataaaggaaagtagattttgtatctgcctcaaatatttgtggcatttaacaagctataagttttcaaaagagattataccaaataaatgctggtttgttacatttctatttgatattagccagctcagagtcctttattt

SEQ ID NO: 341755 - DNA, 204 bp, Homo sapiens
ttgacagtgtttagttgaatgagactgagaaagttcaaataatggaaagtcactgtgtttatccttaaaatttgttgttggtataaaaattttctgaagagaagaaataaaatgacgcatttgttttatttccacagtgttcaaagagttactttttaggactgaacaagagaaatctggtgttcctcatattcccaaaattgc

SEQ ID NO: 341756 - DNA, 515 bp, Homo sapiens
tatatatattgatagattctttttcaaagttaacatgtaactaccttttttaaaaagattcataaaacctttgtttttctctatagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcaggtaagattatctctttggtcaagtcttcttgtctgttggtttaaagtagctgagcctgttttgtcttcctcaaaagaaaatagctttatttgagaattaggagtttcaatagctcacagttaataaaggaaagtagattttgtatctgcctcaaatatttgtggcatttaacaagctataagttttcaaaagagattataccaaataaatgctggtttgttacatttctatttgatattagccagctcagagtcctttatttaaaaaaaa

SEQ ID NO: 341757 - DNA, 6385 bp, Homo sapiens
ggcacgagctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacggagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtagggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattacca

SEQ ID NO: 341758 - DNA, 6334 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacggagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtagggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattacca

SEQ ID NO: 341759 - DNA, 4053 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtacctgtgagtacaagttttcatttatgtgacgctaaagagcacaacaaaataaaaacttatttctctagaattatacctaagtcccaagaaaattaactttcactcacaaaagattgctggcataccttaagcatcatgtgatccaattaatcacagactgaatcccatccattcctgatggctacactatccaaaaaatagagggataagtagatctttaaaaagctttttaattcttttaaaaactggatcattatagaggaggctttctgtttgagaacatttttatattcatccctaaagagtaaacataagtggaatttttacctctttttatttcatggataatatttaccaactagaaaatataagaaatttgattaaaacaccagtgataataggtagcttacaggtgccagtagtaaggt

SEQ ID NO: 341760 - DNA, 3802 bp, Homo sapiens
ccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtaggacattgaaatatgtaaaagtgttagagtggtatcaagggtgatgtaataattaaaatatttatcatttattgatcatatttattctaccatgtgtgctgtacaaagtgctttatatgtgtccgtttcatgtaatcatttatcattaataaccataacaggtaggtgatattagccttcgttatacatattaagaaactgaatgaagctcagagcagtttttacataatttgcaaatatttgtatgtggatagttctgtattattgttctttaaaacatcagcaggccgggcgcagtggctcacgcctgtaatcccagcactttgggaggccgaggcaggcggatcacaaggtcagagatcgagaccatcctagctaacaaggtgaaaccc

SEQ ID NO: 341761 - DNA, 400 bp, Homo sapiens
gatgctcagtcgttttaccagggacgctggtcaggaagaggatgccgtgattgtgaaaattcctggagcaggagacaaagtttcattaatatctcttctcgctcttgtggagcggtcctcatgcgttgggcctgtgacttcacgaagctgctttcttccacctggaccctgatacagtacccagagaatgccatgattatagcccggtgggctcttcttgccgactgccctgagaaaaccaaggcactgagaacaacaggtgttacagcgaagagagagtttaatcacagggccagccacgtgtgagaatgggcgaggtttctcaaatctgcctccctgagaactcggcggcttgagtttttaagggtagtttggtgggtgggggcctggggagctgaaa

SEQ ID NO: 341762 - DNA, 566 bp, Homo sapiens
atgtgacactaatgactcttctctcttcagattcccgatacattcttctgcctgtcgtgttacatcacctccacattcacttgcaagaacagaaggacctgatcatgtgtgcacgtatccttagcaacgtattttgtcttatcaagaaaaatagctcagtaagtaaatacaggtcatagtatatagctcccttcaaatggcttctggaaataaacttgtaatagtctacaaagaaaccgcactaaagaggaagcctctgagacccacttttatttccagctgggctggactttttgcttctctttggaaggaatttttttaaccttgtgggattctgtaaccccaaataacctgggttccccaaacttgtatttcaaggaagaactgcatactgagtgagaaaaatgagaaatctcaaagcctcccacgtgtgtctttaatcttgatatgatgactgctctgtggcaagaataaattactgcttgcaacatgaagtcgtttttgatccattctgtgaaaggctacttcatgatactcagaacttggctgtggtccttgggccgggt

SEQ ID NO: 341763 - DNA, 405 bp, Homo sapiens
ccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactgtaagatcatagagcagat

SEQ ID NO: 341764 - DNA, 7174 bp, Homo sapiens
  misc_feature (2870)..(2870): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341765 - DNA, 2427 bp, Homo sapiens
  misc_feature (1)..(2): n is a, c, g, or t
  misc_feature (5)..(8): n is a, c, g, or t
  misc_feature (313)..(313): n is a, c, g, or t
  misc_feature (597)..(597): n is a, c, g, or t
  misc_feature (2137)..(2137): n is a, c, g, or t
nngcnnnnacttccaggagtgatccgtaattgtgccaattgctccttttttcggagtgggggtggtgtggggtggggacggggacagagtctcgctatgtcacccaggctggagtgcaatggcgtgatctcagctcactgcatctctgcctcctgggttcaagcgattctcctgcctcagcctcctgggtagctgggattacaggtgtccgccaccatgcctgggtaatttttgtatttttagtaaagacggggtttcaccatattggccaggctggtctcgaactcctgacctcaggtgatccacccacctnggcctcccaaagtgctgggattacaggcctgagccactgcacccagtcacaatcactcttaattctgtgccatctctttccgccatgcctctggtgtgcagcctgttttgagcctagaaaagatgaattgtgccttatagaggggcagctttcagtgtgggagccctcatagacccagaggaacagacactgtcatgggccagcacagagcacttggcgtccctaagggcagtgactactgtgattcccctgtctctgagcccccttctgcctttgtgttcatngcacagcctgtgaacccagattctcggctgggcatctgaccttcgaccctgtgttatgtttaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggtgagtcgtttttattcatggcttaaagtgcttaagtaccccaggtgtgctgcgtgtgtccctgtgggttgacattctttctaaccctctttactgtggtatctgtcacccagactaacgagggaatataattccctaagcagaaaggaaattagttcattcattggacacaccccgtaactctgatccgcttatggtgtccctggttctggagtgaaagttaaagagaacgtccattggggatttcttggtaatacatctctcattctcttttgtttaatattgaacatggtatttttttattgaggtgaaattcacataatacaatcattttaaagtgaaaacttcagtggcatttagtccattcacagtgttgctcagccaccacttccctcatgtttcaaaacattttcatcaaaatgatgaaaaaagaaaccttgtggccgggcacgttaaaaaattttgccagtctgaagagtctgattggatttgatatgttgtttttctactggctcttttaaaaatttttaatttttaaattcttattaaaagaatgtatttataagagtcctcccacctcagcctcccgagtagctaggactacaggcttgcaaaaccagggctgactcattttttaattttttatagatacagggtttcactgtgctgcccaggctggtctcaaactcctggcctcaaccgattctcctgcctgggactcccaaagtgctggaattacgggtgtgagccactgtgcccatccctctgttttctctttttacccacggagatcacactttccgtcgtggggaggctggaaaatctggtgttcatatgccacttggtctggttgttctgcagtctgcatgattgtctgatttttcccagggagctttgaaaataccgattccttggttcagtcccacacctatgttggagtggggtggttcctcacatcatttagcttcgttgcagaaaactctccttcagatcttaaggatctttggaataaggctctttcatcttttctggacttttttttttttttttccttgacaaatgagaatcctctccaccctgatctacccaagtgtttcatgcctcatggaggaaagagatacttgcacatgcatttttatagcagcacaatttgcaattgcaaagatatggaaccagcccaaatactcatcagtcaacaagtggataaaggaactatgagatatatatatatatatatatatatatataatgatgaaatgctacttagccatggaaaggaatgaattaatggcattcgctgcaaactggatgggantggggactattatctaagtgaaataactcaggaatggaaagccaaatgtcgtatgttctcactcataagagggagctaagctatgaggaagcaaaggcttaagaataatacaatggactttggcgagtcagggggctgaaagggtgggaggacggtgagggataaaagactacaagttgggttcagtgtatactgctcaggtgatgggtgcacgaaaatctcataaatcactgttaaaaaacttactcatataaccaaacaccatgtgttccccaaaaacctttggaaat

SEQ ID NO: 341766 - DNA, 7024 bp, Homo sapiens
  misc_feature (2720)..(2720): n is a, c, g, or t
tgagtccaacggtgtgactgatcaggctgaggccgagaagcagtacgaagactcctgccgcgtataccaggcatccagccccgatgaggaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341767 - DNA, 6277 bp, Homo sapiens
  misc_feature (1973)..(1973): n is a, c, g, or t
aggttatcggctctcctgatttagttcatgatgcatgactcgactctttggatccaccaacccatgtgccgctcccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341768 - DNA, 5956 bp, Homo sapiens
  misc_feature (1652)..(1652): n is a, c, g, or t
tgcattctgcaggtaactctaaggatcccgttgggctgtcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341769 - DNA, 5605 bp, Homo sapiens
  misc_feature (1301)..(1301): n is a, c, g, or t
cttgaacctgctgctttgcaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacgaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341770 - DNA, 7800 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaa

SEQ ID NO: 341771 - DNA, 3208 bp, Homo sapiens
ccatcaatatcacacaataccggatgttggtcattaaggttcttgtagttgaagtacaacgatgatttttcatgtcattggtcgtggttagattccatgtgagaataatgacaatatatattgcatttattttaagtactatttttgttattgggtttgttggatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341772 - DNA, 2208 bp, Homo sapiens
tttgctttcagaaaaagtgttcaaacagtgctgactgtgtacctcaaggccctctgacctcaaattaattggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341773 - DNA, 6989 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctccccccgaatgcatacggcgggtcctctctatctagctccagcctctcgcctacgccccgaatg

SEQ ID NO: 341774 - DNA, 7032 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgttttactcttcaagtgttcagccatgaggttttctacagttggcccccccatatttttttaacccaacccacggttttggggtggttacccacatcaacccttttatctcttgtggaaaggaccccccccactttcttcagggttttttctttttttggacccatctcccctttggggccttggttaaaactggaaatttttttaaccattttcttttccctgtcggggaaataacaaaatttctgttcacagcgggg

SEQ ID NO: 341775 - DNA, 1585 bp, Homo sapiens
gtgttttctcttgccattttcgtttgccaggttcgttctgacttctaagaatgatcagtggatcgacttttggcggcatcttgtcatagcctctggtctaattgggtcgttcaatgcaaagggtggatccgggtctgggctcctctggtatgattgacttgatgccgctcactgctactagttacaatctgtttgtaaccagttctggcttctcggtcaaggagcgattttctggtgtagacatccgtgtccgtgtcaaggtttgttgtcacgtggcccagagtttatgctatccgtcagtccatgctcccaatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341776 - DNA, 6425 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaa

SEQ ID NO: 341777 - DNA, 1048 bp, Homo sapiens
cccctgcagcctggatataggcgaagagtgcagcagagcagctgttggaaccagccattcgcactgtgcagacttcgcgtccctggctaagggggttaactttgagactgtaataagcttaaacttatctccctggtgaaggaacacttgcatgagaataagaggtcttccctaggcattttaaaccttttgtcttgcctcttctccacccagtcagcaattaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341778 - DNA, 2229 bp, Homo sapiens
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggaaggttgtgtccctgttttgtttttgtggcgtacaagatgttccagtgccttctcccccttcccacgtggagccacgggtttggatcgtggctgtagatcatcgtagcgctgtcattgctggactaaaagaggcctttgagcaggtgccagatgcagaccacggtgggaaaagatgaggcccccaaacaatgccacacagccggccgatctctgtaaatttatggcgtaatcttgccataatatgggaacgaaataaacttgtgatgaactccgtgggaggaagtgactcatgggaggggatcgttgatgcggtatttatattggacagaacttctgaactcactcaagcccttttcttagtgaggaagctgggctgggagcatcatttcctacagccacatgttgttgagcaccctttggttgtcggggggaaggaaaaaataaaacctctgattctttaatgtgcagaccccacagctctctttggcctgcgtcaagagcaggcatagccacagtctatcagagataaagtgtgcagttgaacgcttttaaacgtgggtgcctgtcttggcctgggggtgctcttatgagtcagcatgt

SEQ ID NO: 341779 - DNA, 515 bp, Homo sapiens
tttgtgtgtggtctggtgtgtgtctggtatgtttgctgggtgtgtgtagtgtatgtgtgtgtggtgtgtgtttggtgtgtgtagtgtgtgtgtgtgggtgtgtgagtgtgtttgtgtggtggctgtcggtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341780 - DNA, 1038 bp, Homo sapiens
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaaggtgtgtacgaggtcatggggtacattgaccggctgtgggctggttggttctggtgggtgagtgacgagatattaaaataggaacacctaagagtgatatttatacagacattttatctttttatgcatatgtgtgtgtgtgtatgcaataaatacatatacaatacacatgtataatacagtacgtaaatatgtagttacatg

SEQ ID NO: 341781 - DNA, 341 bp, Homo sapiens
caggcctgagcccccgcgcctggccgcgactccatcattttaaatattatatttaactttctatttctttcatcaactctagatactcccctccctgccttacttccttttttctccctttttctcactttgtagttaaagattatttatcctacaaggtcaaagaggaaaatcagaaaaccataggttcagacctgcataaagcaccagtcattaacctcatgtaacaagtgatgcctttcatgtctaaatgaaaactgcggaaaggagccaggtgtaggcgagcagcgcacggctttcgcagggagggtgaggggaatacccttctctggtgtttgcag

SEQ ID NO: 341782 - DNA, 389 bp, Homo sapiens
tcatttcccaccaaatgttccagatctcatcagacaagccctgaatgtctttctctgttgtctccctccattccaggtgctgttcaaccagttcaaatactttttcaacctctatttcttacttcttgcctgctctcagtttgttcccgaaatgagacttggtgcactctatacctactgggttcccctggtaagttaatcggcattgtttgttcagtaaccttagaggtttggaaacagaaagttctttgtttctctcacttaggcatctggaatgggatggtggccttgtaagggaaaggatgcccttaggccaatacattgggagtctctgagactttaacgttgaagctccatttcatataccgcctggatcaaactatagcaaa

SEQ ID NO: 341783 - DNA, 7537 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341784 - DNA, 6874 bp, Homo sapiens
  misc_feature (2570)..(2570): n is a, c, g, or t
ggatcccactgtcctacctggggtagaggtgtttgtaggggaaggaccagctctccggcaggctgagttagtgcagtgaggctcagctcactgcagcctccacctcctggtttaggtttgagattagttacaccagctcatctcaagccctggtttgtgcttcgtcccacagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341785 - DNA, 6458 bp, Homo sapiens
  misc_feature (2154)..(2154): n is a, c, g, or t
atttgctaaagtctagagacattctggttgtcaccatggagggtgtatgactggcatctagtgcgtaggggccagggatgctgctcaacattgtacagtgcacaggaggggccctgcagagcaaagagttatctggccccaaatgttcacagtgacgaggttgagactccctgttctagtccttatcttccctattctttcagtggaccacagtttgatgatatctgcagtcccaagtgtaaatctaaaatcatagcatgtgagtctattccagttgaaatagtaataactttcaaaacaaaggtcttaaatccatttgatctttctttcatcattgaaaatcttccaagtgctttgagttttccttttactttctgtagcctttgcccctaaatgaggccccttctcgcttttcatcttcagccaactgaaaaaacattggtgtctgttaagtgcactttgtacactgtctgtcatgggaagcgggctttgccgctgaaagagggtgttcctttcagtttctcattccttccggcctccctctctaggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341786 - DNA, 7563 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341787 - DNA, 7520 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 341788 - DNA, 7103 bp, Homo sapiens
  misc_feature (3233)..(3233): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagnggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttcaaaaaaaaaaaacaaacagaaacaaa

SEQ ID NO: 341789 - DNA, 3540 bp, Homo sapiens
  misc_feature (3262)..(3262): n is a, c, g, or t
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtaaggaaatcctgccaaggaattaattgtttacaaaaccttcttcaaatgctgcaacagagagaagaaacgtggtggaaaaattcttgggttcccaagccacattggattcccagccccagcgaatgcaggcccagcaccatggtttagaacctccttcaattaacaaggttttgagctgttaagcccttaaccagatggaggaagtggagttggagatgtgtgtggtgtgttgcactttgccatttgtacctggtcttgaaaaaatactccagagttatcagttgattgaggagagcaaggtggaaggtttgcagacttggtgatttcactggggtcttaataaaaaggggtgggggatctgaaaaatgccctcctggcctgaactgagcccagtagaagtcccatccttggagctccagggagggccagagtccactgcctcggggatgtgcaagtaacagagcttggctgctgtgccacagtgacagagatgatgtcacttgggcctttgcagcctgcaaacccacccccattactgacctggaacttcaggatgatccttctgaccttttcagagaatgtgctcagtctctgaatcacccaggtaggtggagtttggttaccgagtgccctagatacagacacatgcagctgaggccacttntggttatgaggagacggcgggtgcgggaaggtcagctgcgctctggagagtctcacagagtccgctttccatcctactgtgttggctgatgagttcagcctgagaggaggcactagaattctgcctgcttctaactggaaaagcgggctgtctttcgtcgggttctggaagagtacaagaacattacagaatatagtcaggggttccctgagctgtgcgccgtgcgaccttccgtggtctggtcccatctttcccgtgggtcctcatttcctcttccg

SEQ ID NO: 341790 - DNA, 1034 bp, Homo sapiens
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgattcgcgaatgggttacagctcggttcg

SEQ ID NO: 341791 - DNA, 412 bp, Homo sapiens
ctggtcatctcgggagactccctggaggtgagcttggggacccctgagagccagtcctcccagcagcctgggtcttacccggcttcggcaggggcactgcaggctcggcagcgacctccaccaacgcaccacctctccctccaccaacgcaccacctctccctccaccctgcaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggtaggcgaggctcaggctgtgctgctggccctggcctgccggtgcaccaggctccctttccctaaggatatttggacactgctgctctttctt

SEQ ID NO: 341792 - DNA, 2581 bp, Homo sapiens
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341793 - DNA, 439 bp, Homo sapiens
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaagtgagtgatggggattggaggaaggggtaggattggaggaaggtcctcatgcacagagtgtggttgggagctggagtgggaacccagttcggtctcttccgaaggcttaggacccatgtgactgaatttaggggctgtccccttgcgagggcactaggacaacaggaggggcgcacctgcaatacggatg

SEQ ID NO: 341794 - DNA, 2757 bp, Homo sapiens
agtcagtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcgcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaataaaaataaaaaaaaaaaaaaaaaaaaaaaaaaaaaaaaaaaaaaaaaaaaaaaaaaaaaaaaaaaaaaaaaaaaaaactttggggcccgtttggcccaatcgatttttaaattgggccagttttttcattgggcccgaattcggggttaattggccaaattccccttaaggggggccgtttacaatttaatggcccgtggtttaaaacggtcggattgggaaaaccctgggggtaaccaaattaaaacgcttggaagaaaatccccttttggcaggtgggggaaaaagcaaaaggccccgaccggatggcctttccaaaaatttgccaaccttgatggccaaaggaaatttgaaggcgtaaatttttggataaaattggggtaaatttttggttaacaagtttttttttaacccaaagggccgaaatgggctccttt

SEQ ID NO: 341795 - DNA, 2219 bp, Homo sapiens
aggctggtacggatcgcggatttaaggcatggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341796 - DNA, 2337 bp, Homo sapiens
accccggggccggggctacagggctggctctgccccggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341797 - DNA, 2153 bp, Homo sapiens
gcggccgccgaggggcccgcagtagctgcgctcccggggaaggagccccacagtccccagatactatcaaatcagcctgggaagcatcttttcgctcagcaagttcaagagaacaaatatgttacaatccttgcctattcttgcctccacttcataatgagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341798 - DNA, 1581 bp, Homo sapiens
aggctggtacggatcgcggatttaaggcatggcgtcccgcccccgccccggggaacgctgcctctgccgcaaagatgcccccttccgctggaaagcggtgcctccctgggtgctcgcgaaagcagccctgagaatggcagctctcagaggttgaagtcattcttttcgggggacggggcacggcgactgtttgattgggggacttgttttcctacaatttcacaaaaagcctcgctagaggaatgtgcaaggacagaagggaaatcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaataaaaataaaaaaaaaaaaaaaaaaaaaaaaaaaaaaaaaaaaaaaaaaaaaaaaaaaaaaaaaaaaaaaaaaaaaaactttggggcccgtttggcccaatcgatttttaaattgggccagttttttcattgggcccgaattcggggttaattggccaaattccccttaaggggggccgtttacaatttaatggcccgtggtttaaaacggtcggattgggaaaaccctgggggtaaccaaattaaaacgcttggaagaaaatccccttttggcaggtgggggaaaaagcaaaaggccccgaccggatggcctttccaaaaatttgccaaccttgatggccaaaggaaatttgaaggcgtaaatttttggataaaattggggtaaatttttggttaacaagtttttttttaacccaaagggccgaaatgggctccttt

SEQ ID NO: 341799 - DNA, 650 bp, Homo sapiens
agttcagagtttgatcccttggggcctttttctcgcacttgagatttcactatcatgtcgttcaattaatcatatttcccttctcccattttattcaaaaccgtcttccagttccctcataatcgtaatttgcgtcattgccttttatcgttgattaattaggaagccgaaaatggtaatggagggtcgggccaataaattagctttaggaacagacggacggacgtccgaggctgctgcatgggtgggcgctgtccaccgaagctggcgggggccaccgtcgctgcagctggcttctcaggaaggcgttaaggaaaaggcgcgcggtactggctgaatggagagatccactctgaaataaacccggtggccacaagggaaaacttctcactgcactaggtggagagactcctgtgacgcttagcttttcccgtttggtatagaaaaggaaagactgggttgttatagaaatggagaagaggaaggatggggtaggataagagtcagactcctgttactttcagaggcctccctactagcgggtaaacaggtttaaagtctgggccttattaggagcctttttttttccagaactggaatgttagatttacttttgcagcctttccttcctctttccacttacctactgg

SEQ ID NO: 341800 - DNA, 290 bp, Homo sapiens
gtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctggtaagtctatttgcattgatgtgggagggggatgggaggaagacagtttgg

SEQ ID NO: 341801 - DNA, 906 bp, Homo sapiens
aagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttggtaatcatttttatttttaatcacccttgccccccaaccccaagacctcagagtgccaacagtacccattatagactccctctggggctgcgcagaacgcaccaagcagagggggggaaaaaccccacgaaaacaaaaacaaacaaaaaaaaaacaggaactgtttgagtccagtaacctgcgctcttcccaccaacctcccacaccccacctccgcccacgtacccgtgtcctgggactaggaggtaccgttatgtccccttccgaggtctggtgacattctcactccaacctcatctcccaagccacgggaaggctgagccaagttctcaccaaagcgcatcctttctgaattttgcagggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggtaccttcctttccaatcctgaaacgattttcccctcctagcagtcccagagggcccgagctttagg
